United States Patent 11,446,398 (REGULATED BIOCIRCUIT SYSTEMS) - sequence listing, part 29

SEQ ID NO: 111596 - DNA, 4037 bp, Homo sapiens
  Payload ID: 1855
  Gene Symbol: BLOC1S6
  Gene Name: biogenesis of lysosomal organelles complex-1, subunit 6, pallidin
  Uniprot ID: Q9UL45
  ENST ID: ENST00000220531
  CDS Start-End: 322-840
acccaccccgtgagcagcccaaaccgaccaccgtcctcccccagctcccaccaatcggatcgcagggactcgagccccacactgctgagtccgctgacactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaatta

SEQ ID NO: 111597 - DNA, 480 bp, Homo sapiens
  Payload ID: 1855
  Gene Symbol: BLOC1S6
  Gene Name: biogenesis of lysosomal organelles complex-1, subunit 6, pallidin
  ENST ID: ENST00000568963
  CDS Start-End: 93-224
tctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctgaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtg

SEQ ID NO: 111598 - DNA, 706 bp, Homo sapiens
  Payload ID: 1855
  Gene Symbol: BLOC1S6
  Gene Name: biogenesis of lysosomal organelles complex-1, subunit 6, pallidin
  ENST ID: ENST00000564765
  CDS Start-End: 262-402
agtggtgggggatggatttaccagaaagatgatcagcttataattcagagaggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaatt

SEQ ID NO: 111599 - DNA, 592 bp, Homo sapiens
  Payload ID: 1855
  Gene Symbol: BLOC1S6
  Gene Name: biogenesis of lysosomal organelles complex-1, subunit 6, pallidin
  ENST ID: ENST00000568597
  CDS Start-End: 69-329
gttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcactttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccatt

SEQ ID NO: 111600 - DNA, 338 bp, Homo sapiens
  Payload ID: 1855
  Gene Symbol: BLOC1S6
  Gene Name: biogenesis of lysosomal organelles complex-1, subunit 6, pallidin
  ENST ID: ENST00000566801
  CDS Start-End: 275-338
agaactccggagaaaccctgggggagtaagcggtttttggcggctgcggcccccgggccctgccccgagtgcagaaatggggaaccgcgccggcccctctgcccagcgcaatgggcggaactgaagtcccgaggggaagctttgtattgggggtgcaattgaaggcggttgatggtgaagccattctgagtttatgtgttgactccgacagaaccaagttgtattgttagacacactggaacaagagatttcaaaatttaaagaatgtcattctatgttggatattaatgctttgtttgctgaggctaaacactatcatgccaagttggtgaatataa

SEQ ID NO: 111601 - DNA, 557 bp, Homo sapiens
  Payload ID: 1855
  Gene Symbol: BLOC1S6
  Gene Name: biogenesis of lysosomal organelles complex-1, subunit 6, pallidin
  ENST ID: ENST00000569076
  CDS Start-End: 217-557
ctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctgcttggacttaaagtatgatgttgaatatccttgatgaacattgatgcaaaaatcctcaataaaatactggcaaaccgaatccagcagcacatcaaaaagcttatccaccatgatcaaacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagtt

SEQ ID NO: 111602 - DNA, 4013 bp, Homo sapiens
  Payload ID: 1855
  Gene Symbol: BLOC1S6
  Gene Name: biogenesis of lysosomal organelles complex-1, subunit 6, pallidin
  ENST ID: ENST00000568816
  CDS Start-End: 590-817
gaactccggagaaaccctgggggagtaagcggtttttggcggctgcggcccccgggccctgccccgagtgcagaaatggggaaccgcgccggcccctctgcccagcgcaatgggcggaactgaagtcccgaggggaagctttgtattgggggtgcaattgaaggcggttgatggtgaagccattctgagtttatgtgttgactccggtttaagtgacacttctccagatgaagggttaatagaggacttgactatagaagacaaagcagtggagcaactggcagaaggattgctttctcattatttgccagatctgcagagatcaaaacaagccctccaggaactcaccacagctgcagttgactgtacgtgcctaaaactgaagaaagcaaaactgcagataaaggaggactgacatattttctggaagagactgtggggaattggtatcacgtcttccttaaatgtttggtaaaaattaccagtgaagccgtttggtcccggtactgtcttttttggaagacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaatt

SEQ ID NO: 111603 - DNA, 636 bp, Homo sapiens
  Payload ID: 1855
  Gene Symbol: BLOC1S6
  Gene Name: biogenesis of lysosomal organelles complex-1, subunit 6, pallidin
  ENST ID: ENST00000564310
  CDS Start-End: 1-172
gctggggacaggtttaagtgacacttctccagatgaagggttaatagaggacttgactatagaagacaaagcagtggagcaactggcagaaggattgctttctcattatttgccagatctgcagagatcaaaacaagccctccaggaactcacaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaagaattcaaggacgaagatatcaatgaccagcacagagatgtaatcttcctctcggccacacacctgggtgtttcccttatttttttgctgcgtgtttccttcatgtcgtccaatttcttttcttattctcatatttggctagatttttaataccagatctatgtcagctccttctcaaacctaaaattcagagccccagctctgttgagcgtgtattatatttcagttgctttatacatgttatctcataacagcaaccttaggaggtaactattgttattaccattttacaggtgaggaagctgagacgca

SEQ ID NO: 111604 - DNA, 616 bp, Homo sapiens
  Payload ID: 1855
  Gene Symbol: BLOC1S6
  Gene Name: biogenesis of lysosomal organelles complex-1, subunit 6, pallidin
  ENST ID: ENST00000565409
  CDS Start-End: 302-529
gtgttgactccggtacgtcattggttatttgtcatacggcagtggtgggggatggatttaccagaaagatgatcagcttataattcagagaggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttat

SEQ ID NO: 111605 - DNA, 573 bp, Homo sapiens
  Payload ID: 1855
  Gene Symbol: BLOC1S6
  Gene Name: biogenesis of lysosomal organelles complex-1, subunit 6, pallidin
  ENST ID: ENST00000565216
  CDS Start-End: 21-416
gtgttcccagctggagggacatgagtgtccctgggccgtcgtctccggacggggccctgacacggccaccctactgcctggaggccggggagccgacgcctgcattctttaaaatattcagacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagca

SEQ ID NO: 111606 - DNA, 1052 bp, Homo sapiens
  Payload ID: 1855
  Gene Symbol: BLOC1S6
  Gene Name: biogenesis of lysosomal organelles complex-1, subunit 6, pallidin
  ENST ID: ENST00000567461
  CDS Start-End: 358-585
agacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctgacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccc

SEQ ID NO: 111607 - DNA, 1839 bp, Homo sapiens
  Payload ID: 1855
  Gene Symbol: BLOC1S6
  Gene Name: biogenesis of lysosomal organelles complex-1, subunit 6, pallidin
  Uniprot ID: Q9UL45
  ENST ID: ENST00000567523
  CDS Start-End: 66-308
aggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctcc

SEQ ID NO: 111608 - DNA, 688 bp, Homo sapiens
  Payload ID: 1855
  Gene Symbol: BLOC1S6
  Gene Name: biogenesis of lysosomal organelles complex-1, subunit 6, pallidin
  ENST ID: ENST00000565323
  CDS Start-End: 84-617
aagcggtttttggcggctgcggcccccgggccctgccccgagtgcagaaatggggaaccgcgccggcccctctgcccagcgcaatgggcggaactgaagtcccgaggggaagctttgtattgggggtgcaattgaaggcggttgatggtgaagccattctgagtttatgtgttgactccggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagt

SEQ ID NO: 111609 - DNA, 494 bp, Homo sapiens
  Payload ID: 1855
  Gene Symbol: BLOC1S6
  Gene Name: biogenesis of lysosomal organelles complex-1, subunit 6, pallidin
  ENST ID: ENST00000562384
  CDS Start-End: 254-481
tctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctgcttggacttaaaacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttg

SEQ ID NO: 111610 - DNA, 1996 bp, Homo sapiens
  Payload ID: 1855
  Gene Symbol: BLOC1S6
  Gene Name: biogenesis of lysosomal organelles complex-1, subunit 6, pallidin
  ENST ID: ENST00000566753
  CDS Start-End: 90-347
gtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcaccttggacttaaagtatgatgttgaatatccttgatgaacattgatgcaaaaatcctcaataaaatactggcaaaccgaatccagcagcacatcaaaaagcttatccaccatgatcaagtaggcttcatccctgggatgcaaggctggttcaatatacgcaaatcaataaatgtaatccagcatataaacagagccaaagacaaaaaccacatgattatctcaatagatgcaaaaagcctttgacaaaattcaacaacccttcatgctaaaaactctcaataaattaggtattgatgggacgtatttcaaaataatagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttataccccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatataaatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatacccagaatctacaatgaactcaaacaaatttacaagaaaaaaacaaccccatcaaaaagtgggcgaaggacatgaacagacacttctcaaaagaagacatttatgcagcc

SEQ ID NO: 111611 - DNA, 1286 bp, Homo sapiens
  Payload ID: 1856
  Gene Symbol: BOD1
  Gene Name: biorientation of chromosomes in cell division 1
  Uniprot ID: Q96IK1
  ENST ID: ENST00000285908
  CDS Start-End: 153-542
caccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcaaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaattatttgatactttta

SEQ ID NO: 111612 - DNA, 1562 bp, Homo sapiens
  Payload ID: 1856
  Gene Symbol: BOD1
  Gene Name: biorientation of chromosomes in cell division 1
  Uniprot ID: Q96IK1
  ENST ID: ENST00000311086
  CDS Start-End: 225-782
cgagcaggccgtttctgccgcgtccaccacaacctctgctgtatcagagggggccttcgccgccgccgcccccaccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcagtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaattatttgatacttttactccgaa

SEQ ID NO: 111613 - DNA, 353 bp, Homo sapiens
  Payload ID: 1856
  Gene Symbol: BOD1
  Gene Name: biorientation of chromosomes in cell division 1
  ENST ID: ENST00000462674
  CDS Start-End: 229-353
agtactacctgaggtttcaggcacccactggggatcttggaacgtatcccctgaggggggaggggactaccctcttgagcggctggtgagggagagtggttggaaccttcccatgtacagctccttagctgttccttctgagaattccagccagcttaccaaaacctgaggcagaaagtggataattttgtgtcaacacatctggacaagcaggaatggaatcctacgatgaacaaaaaccagttgcgaaatggtctgaggcagagtgtggttcagtcagggatgttggaagctggagtagacaggattatttctcaggtggtggatccaaaacttaaccacatcttcaggcc

SEQ ID NO: 111614 - DNA, 850 bp, Homo sapiens
  Payload ID: 1856
  Gene Symbol: BOD1
  Gene Name: biorientation of chromosomes in cell division 1
  ENST ID: ENST00000477985
  CDS Start-End: 1-355
actggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaaggtcagggatgttggaagctggagtagacaggattatttctcaggtggtggatccaaaacttaaccacatcttcaggccacaaatagaacgagcaattcatgagttcctggcggcccagaaaaaagcagctgtgccagcaccccctccagagcccgaaggccaggaccctccagctccatctcaggacacttcctaagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagc

SEQ ID NO: 111615 - DNA, 814 bp, Homo sapiens
  Payload ID: 1856
  Gene Symbol: BOD1
  Gene Name: biorientation of chromosomes in cell division 1
  ENST ID: ENST00000480951
  CDS Start-End: 218-475
gccgtttctgccgcgtccaccacaacctctgctgtatcagagggggccttcgccgccgccgcccccaccaccgcccctgccgccatcgccacctccgccgctgccgccttggggccctcctccttcaccgcccccttcaccacctctacacgttctaggccttctgtcctggagaagaagctatagtcgttctcccttgtgggcccggggcgcagccatggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctac

SEQ ID NO: 111616 - DNA, 10565 bp, Homo sapiens
  Payload ID: 1857
  Gene Symbol: BOD1L1
  Gene Name: biorientation of chromosomes in cell division 1-like 1
  Uniprot ID: Q8NFC6
  ENST ID: ENST00000040738
  CDS Start-End: 137-9292
ttccggggttgctctggatccgctggttccgtaacaacatcccgttggcttccctcaggcggcgggaccagtgcagccgccgcctcccaggatcgtccgccggtcagggcccttgccctccccggcacaggccaccatggccaccaacccacagccgcagccgcctcctccggcgccgccgcctcccccgccgcagccgcagccgcagccaccgccgccgccgccgggccccggggctggccccggcgcgggcggggcgggcggcgcgggtgcgggcgccggggacccgcagctcgtggccatgatcgtgaaccacctcaagagccaggggctcttcgaccagttccgcagagactgcctggccgacgtggacaccaagcctgcgtatcagaatctgagacagcgtgttgacaactttgttgcaaatcacttggcaactcacacatggagtccgcatctcaataagaaccagctaagaaacaacattagacaacaagtcctcaaatcaggaatgttggagtctggtattgaccgaattatttctcaggttgtggacccaaagatcaaccacacattcagacctcaggtagagaaagctgtgcatgagtttttggccacgctaaatcacaaagaggaaggaagtggcaacacagctcccgatgatgagaaaccagacacttcccttattacacaaggtgttcctactcctgggcccagtgctaatgtagccaatgatgccatgtcgatattggaaaccataacttctcttaaccaagaagccagtgctgctagggcttcaacagaaacatcaaatgccaagaccagtgagagagcgtcaaaaaaacttccatctcagccaaccactgatactagtactgacaaagaaagaacttcagaggacatggctgataaagaaaaatctacagctgactctggaggtgaaggactggaaacagccccaaagtctgaagagttcagcgacctcccctgtccagtcgaagaaattaaaaattacacaaaagagcataataatttaattctgctaaataaggatgttcaacaggaaagcagtgagcaaaaaaataaatcaacagacaaaggtgaaaagaagccagacagcaatgagaaaggagaaagaaagaaagaaaagaaggaaaagactgaaaagaaatttgatcactcaaaaaagagtgaagatacacagaaagttaaagatgaaaaacaagcaaaggaaaaagaagtagagagtttaaaacttccttcagaaaagaacagtaataaagctaaaactgttgaagggacaaaagaagatttctctttgatagattctgatgtggatggacttacagacatcacagttagctctgttcataccagtgacctttcatcttttgaagaagatactgaggaggaagttgtaacgtctgatagcatggaagaaggagagattacgtcagatgatgaagagaagaacaaacagaataaaacaaaaactcaaactagtgattctagtgaaggaaaaacaaaaagtgtacggcatgcgtatgtccacaaaccatatctttactcaaaatactatagtgattctgatgatgagcttactgtagaacaacgacgacagtccattgccaaagaaaaagaagagaggcttttaagaaggcaaatcaatagagaaaaacttgaagaaaaacgaaaacagaaagcagaaaagacaaagtcttcaaaaaccaagggtcaaggcaggagtagtgtggacttagaagaatcatcaacaaagagtttggaacctaaagccgccagaattaaagaagtccttaaagaacggaaagttttagaaaaaaaagtagccttaagcaaaaagagaaaaaaagattcaaggaatgttgaagagaactccaaaaagaaacagcaatatgaagaagattccaaagaaacccttaaaacaagtgagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaatccaaattagaaagagaacataaaagacggacatctacccctgttatcatggagggggtacaggaagagactgacacaagagatgtaaaaaggcaagtagaacgctcagaaatttgcaccgaagagccccagaaacagaaaagcacacttaaaaacgaaaagcatctaaagaaagatgattctgaaacaccacatttgaaaagcctacttaagaaagaggtgaaatcctccaaggagaagcctgaaagagagaaaactccatcggaagacaaattgtctgtgaaacataaatataaaggtgattgtatgcataaaacaggtgatgagactgagcttcactcttctgagaaaggtttaaaagtagaggaaaatattcaaaagcaaagtcaacaaacaaagctttcttcagatgataaaaccgaacgaaaaagtaaacataggaatgaaaggaaattatcagtattaggcaaagatggaaagccagtttctgaatatattataaaaacagatgagaatgttcgtaaagaaaacaacaaaaaagagagacgcttgtcagctgaaaaaactaaggcagagcacaaatcaagaaggtcaagtgattctaaaattcagaaagattctctgggttccaagcaacatggtatcacattacagagaagaagtgaaagttattcggaagataagtgtgatatggactccactaacatggatagtaatttgaaaccagaagaggttgttcacaaggagaaacgacgaacaaagagcttgttagaagagaaacttgtgttgaagtctaaatcaaaaactcaaggcaaacaggtaaaagttgtagaaacagaattacaagaaggtgccacaaaacaggcaaccactccaaaaccagacaaggagaagaacacagaagaaaatgactcagaaaaacagcgtaagtctaaagttgaagacaaaccttttgaagaaactggtgttgaacctgtattagagactgcttcttcttcagcacatagtacacagaaggattctagtcatagagccaagttaccattagcaaaggagaaatataagagtgataaagactccacttccaccaggcttgagagaaagttgtcagatggccacaaaagcagaagcttaaagcatagtagtaaagacataaaaaagaaggacgaaaataaatcagatgacaaggatggtaaagaagttgacagtagtcatgaaaaggccagaggtaatagttcactcatggaaaagaaattaagtagaaggttgtgcgaaaatcggagaggaagcttgtcacaagaaatggccaaaggagaagaaaaattagcagcaaacactttgagcactcccagcggttcctcccttcagagaccaaaaaagagtggtgatatgacattgatccctgaacaagagccaatggaaattgattctgagccaggtgttgaaaatgtgtttgaagtatctaaaacccaagacaaccgcaataataattctcagcaagacattgactctgaaaatatgaaacaaaaaacttctgccactgttcaaaaggatgaattgagaacttgcacagcagattcaaaagcaacagctccagcttataagccaggccgtggaacaggagttaatagtaattctgaaaagcatgccgatcatagaagcaccttgaccaagaaaatgcatatacaaagtgctgtgtccaaaatgaaccctggggagaaagaacccattcatagaggaactactgaagtgaatatagattctgaaactgttcatagaatgttactgagtgccccatcagaaaatgatagggtacagaagaatttgaaaaacacagctgctgaagaacatgttgctcaaggagatgccactcttgaacattccacaaatttagactcctcaccatccttaagttcagtgactgttgtgcctctgagggaatcgtatgatccagatgtaattcctctgtttgacaaaagaactgttttggaaggtagcacagccagcacctcccctgcggatcactctgctctccctaaccaaagtctgactgttagggaatcagaagtccttaagacaagtgacagcaaagaaggtggtgaaggtttcacagtagatacaccagcaaaagcaagcatcactagcaaaagacacattccagaagctcaccaggctactttattggatggtaaacaaggaaaggtaatcatgcctcttggaagtaagttaacgggcgtgattgtggaaaatgagaatattaccaaagaaggtggcttagtggacatggccaagaaagaaaatgacttaaatgcagagcccaatttaaagcagacaattaaagcaacagtagagaatggcaagaaggatggcattgctgttgatcatgttgtaggcctgaatacagaaaaatatgctgaaactgtcaaacttaagcataaaagaagcccaggtaaagtaaaagacatatcaattgatgttgaaagaaggaatgaaaacagtgaggtagacaccagtgctggaagtggctctgcaccctctgttttacaccaaaggaacggacaaactgaggatgtggcaactgggcctaggagagcagaaaagacttctgttgccactagtactgaagggaaggacaaagatgtcaccttaagtccagtgaaggctgggcctgccacaaccacttcttcagaaacaagacaaagtgaggtggctttgccttgcaccagcattgaggcagatgaaggcctcataataggaacacattccagaaataatcctcttcatgttggtgcagaagccagtgaatgcactgtttttgctgcagctgaagaaggtggggctgttgtcacagagggatttgctgaaagtgaaaccttcctcacaagcactaaggaaggggaaagtggggagtgtgctgtggctgaatctgaggacagagcagcagacctactggctgtgcatgcagttaaaatcgaagccaatgtaaatagcgttgtgacagaggaaaaggatgatgctgtaaccagtgcaggctctgaagaaaaatgtgatggttctttaagtagagactcagaaatagttgaaggaactattacttttattagtgaagttgaaagtgatggagcagttacaagtgctggaacagagataagagcaggatctataagcagtgaagaggtggatggctcccagggaaatatgatgagaatgggtcccaaaaaagaaacagagggcactgtgacatgtacaggagcagaaggcagaagtgataactttgtgatctgctcagtaactggagcagggccccgggaggaacgcatggttacaggtgcaggtgttgtcctgggagataatgatgcaccaccaggaacaagtgccagccaagaaggagatggttctgtgaatgatggtacagaaggtgagagtgcagtcaccagcacggggataacagaagatggagaggggccagcaagttgcacaggttcagaagatagcagcgaaggctttgctataagttctgaatcggaagaaaatggagagagtgcaatggacagcacagtggccaaagaaggcactaatgtaccattagttgctgctggtccttgtgatgatgaaggcattgtgactagcacaggcgcaaaagaggaagacgaggaaggggaggatgttgtgactagtactggaagaggaaatgaaattgggcatgcttcaacttgtacagggttaggagaagaaagtgaaggggtcttgatttgtgaaagtgcagaaggggacagtcagattggtactgtggtagagcatgtggaagctgaggctggagctgccatcatgaatgcaaatgaaaataatgttgacagcatgagtggcacagagaaaggaagtaaagacacagatatctgctccagtgcaaaagggattgtagaaagcagtgtgaccagtgcagtctcaggaaaggatgaagtgacaccagttccaggaggttgtgagggtcctatgactagtgctgcatctgatcaaagtgacagtcagctcgaaaaagttgaagataccactatttccactggcctggtcgggggtagttacgatgttcttgtatctggtgaagtcccagaatgtgaagttgctcacacatcaccaagtgaaaaagaagatgaggacatcatcacctctgtagaaaatgaagagtgtgatggtctcatggcaactacagccagtggtgatattaccaaccagaatagcttagcagggggtaaaaatcaaggcaaagttttgattatttccaccagtaccacaaatgattacacccctcaggtaagcgcaattacagatgtggaaggaggtctctcagatgctctgagaactgaagaaaatatggaaggtaccagagtaaccacagaagaatttgaggcccccatgcccagtgcagtctcaggagatgacagccaactcactgccagcagaagtgaagagaaagatgagtgtgccatgatttccacaagcataggggaagaattcgaattgcctatctccagtgcaacaaccatcaagtgtgctgaaagtcttcagccggttgctgcagcagtggaagaaagggctacaggtccagtcttgataagcaccgccgactttgaggggcctatgcccagtgcgcccccagaagctgaaagtcctcttgcctcaaccagcaaggaggagaaggatgaatgtgctctcatttccactagcatagcagaagaatgtgaggcttctgtttccggtgtagttgttgaaagtgaaaatgagcgagctggcacagtcatggaagaaaaagacgggagtggcatcatctctacgagctcggtggaagactgtgagggcccagtgtccagtgctgtccctcaagaggaaggcgacccctcagtcacaccagcggaagagatgggtgacaccgccatgatttccacaagcacctctgaagggtgtgaagcagtcatgattggtgctgtcctccaggatgaagatcggctcaccatcacaagagtagaagacttgagcgatgctgccatcatctccaccagcacagcagaatgtatgccaatttccgccagcattgacagacatgaagagaatcagctgactgcagacaacccagaagggaacggtgacctgtcagccacagaagtgagcaagcacaaggtccccatgcccagcctaattgctgagaataactgtcggtgtcctgggccagtcaggggaggcaaagaaccgggtcccgtgttggcagtgagcaccgaggaggggcacaacgggccatcagtccacaagccctctgcagggcaaggccatccaagtgctgtttgtgcggaaaaagaagagaagcatggcaaggagtgccccgaaataggaccatttgcaggaagaggacagaaagagagcactttacacctcataaatgcagaagagaagaatgtattgttgaactcccttcagaaagaagataagagcccagagacagggacagcagggggcagtagcacagcaagttattcagcaggaaggggcttagaggggaatgctaactcacctgcccacctgagaggaccagaacagacgtctgggcagacggctaaggatccctctgtcagcattcgctatttggcagcagtaaacaccggtgctataaaagctgatgacatgccacctgttcaagggaccgtggctgagcattcctttcttcctgctgagcagcaggggtctgaagacaacttgaaaaccagtaccaccaaatgtattactggccaagaatcaaaaattgctccttcccacacaatgatccctccagctacttacagtgtagctctgttggctcctaaatgtgagcaggacttgactataaagaatgattatagtggcaaatggactgatcaagcatctgctgagaaaacaggagatgataacagcacaaggaaatcattccctgaggaaggagacataatggttactgtgtcttctgaagaaaatgtgtgtgacataggcaatgaagagtctccattgaatgttttgggaggattgaaactgaaagccaacttgaaaatggaggcttatgtgccttcagaggaagagaaaaatggtgaaattctggcaccaccagaaagtctgtgtgggggaaagccaagtggaatagctgaactccagagggagcctttgttggtgaatgaatcactaaatgttgaaaattcaggcttcagaacaaatgaagaaattcatagcgaatcttataacaaaggagagatatccagtggtagaaaagacaacgcagaagccataagcggtcacagtgttgaagcagatcctaaagaggttgaagaggaagaaaggcatatgcctaaaagaaaaagaaagcagcattatctctcttcagaagatgaaccagatgataatccagatgtcctggattccagaatagaaacagcacaaaggcagtgtcctgaaacggagccacatgacacaaaggaagagaactccagagatttggaagaattacctaaaaccagttctgagacaaatagcactacctcaagggtcatggaagaaaaagatgaatatagcagcagtgaaactactggtgaaaagccagagcagaacgatgatgacaccataaaatctcaggaggaagatcagccaataattattaaaaggaaaagaggaagacctcgcaaataccctgtagaaacaacgttaaaaatgaaagacgactccaaaacagatactggcattgtcactgtagaacaatctccatctagcagcaaactgaaagtaatgcaaacagatgaatccaataaagaaacagctaacctacaagaaagaagtataagcaatgatgatggtgaagaaaaaatagtaacaagtgtgcgtcggagaggaagaaaacccaaacgttctctcactgtatcagatgatgctgaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtgtatgggtttttttttttattttgactcttaatgtaaggtggatatttctgtcattttacatggtttcttactgagattttatatataaattataaaatgtttaccaaaa

SEQ ID NO: 111617 - DNA, 4367 bp, Homo sapiens
  Payload ID: 1857
  Gene Symbol: BOD1L1
  Gene Name: biorientation of chromosomes in cell division 1-like 1
  ENST ID: ENST00000482713
  CDS Start-End: 115-396
ctggttccgtaacaacatcccgttggcttccctcaggcggcgggaccagtgcagccgccgcctcccaggatcgtccgccggtcagggcccttgccctccccggcacaggccaccatggccaccaacccacagccgcagccgcctcctccggcgccgccgcctcccccgccgcagccgcagccgcagccaccgccgccgccgccgggccccggggctggccccggcgcgggcggggcgggcggcgcgggtgcgggcgccggggacccgcagctcgtggccatgatcgtgaaccacctcaagagccaggggctcttcgaccagttccgcagagactgcctggccgacgtggacaccaagagtctcgccctgtcgccaggctggaatgcaatggcgtgatctcggctcactgcaacctccgcctcccgggttcaagcgactctcctgtctcagcctcccaagtagctgggattacaagcgcgtgccaccacgccctgctaatttttgtatttttagtagacacaaggtttcaccgtgttggccaggatggtctcgatctcctgacctcgtgattcgcccagtaggcatgagccaccgcgcccggtcgagggttttctcatagtatgtttagttgttctgaggagctttgtatctttgagaaatgcatgtttacaacatccacagtttcttctaaagctttcaggtgaactgcacacagttccactatgtcttctggggaaactcttgaatatcctggtacatcttcctttataaggactcatactgggcccactatgtaaaacgtggtttttcgggatattggaggttttgcaccacagagaattcaattcacttgggagtgttcatctatttaggaagtatagttttttttacttttgtcttcaggaatatgcactgctaccttttagaaataatttctattgcctttattatttttgttgttatttaatgggaaaaggttagacatggccaggtaaatgttatcaaataaagttagttattcgtattcaacaagtggaatttttactttgctgttctcagaaacccatgaatctgtgtgttctcagaaacccatgaatcattatgtatacaaattaaaaattgtaatgtactgctgcaatgtctgaggctcaacttttttattatcctattcccacaaaatgttattggtatgtgtctataatatccctgccagacccttcaaagtaaaggattaaaaccttttttggagggaaggagggaagcacagtatctctgatcatctaatgaaagttaggaccttctctcaagaaaaatgcgcaagtaacacattaaaacgctgtttttctacttcagaatggtcaactataggcaatttcatgagaatcaatctaataacatatacagtttcagtgagttcaggaaccatggaataagaacctattttaatgttcttagcctcttttttgaggtcaagaattgaatgatattgttacaacaaaactcttccattccgaggcacagtacttgtttatatgaacaaggtttctcagggcgcatgactataaaaattagaaataggaatagaattgatgatcaacccttcttctagtaataagacatattcagccacagatgcaggaactttaaaaagcaacagtatggccaggcccggtggctcatgcctggccaccgtgggccaaagtagaagattccctgttcatgcaaagaaccatcactttaatggaatccttgagtttcatctgccacttgaacctcaaagactgacctgctttctgtcaaaaagtcttaacttgtagcatatagagttatagtggattatgtctgtcacgtgcatatttaagaatgaagacatttgatacctgccaggtgctaagagcaaaactgtcatccagtttagtgtgtttaaaccaggatgagaagtaccaaagtctgctgctacaccagaagaccacagaaccctggtcttctgggaggccgaggtgggtggatcattagaggtcaggagttcgaggccaacctgaccaaaatggtgaaaccccatctctagtaaaaatacaaaaaaagtagccatgtatggtggcacatgcctgtagtcccagctactcgggaggctgaggcaggagaattgcttgaagccaggagacagaggttgcagttagccgagattgtgccagtgcactccagcctgggagacagaacaagacttggtctaaaaaacaaaaatttttaaaaagcaacaatacacatttttcaatacagttgcatatactatttaataattatgaaaatttctaatatttctgttgctttgagaaattagaactgaaatgacaccctcccagacaaaaaagaacactcagctatggttgaagttctggtgctcagacgctagcttaaactctcccacaaaatctctctctctctccccctccctgccactaacctctgtacctgctcctggttatgttacaggttatgttctggtacttcctttaccccatgactctctccttctcttctactcccttagttagcaattaggtagattttaatttgatttaaaagatttgttctcattgaataccattttatacttcattttcttatttgaaaaaaaaaaaaatatattcccccctgcttcccaaaaagccaaagttttcttcatcagaacataacattcatatcaatatgatgagtgggccaaagtagaagattccctgttcatgcaaagaaccatcactttaatggaatccttgagtttcatctgccacttgaacctcaaagactgacctgctttctgtcaaaaagtcttaacttgtagcatatagagttatagtggattatgtctgtcacatgcatatttaagaatgaagacatttgatacctgccaggtgctaagagcaaaactgtcatccagtttagtgtgtttaaaccaggatgagaagtaccaaagtctgctgctacaccagaagaccatagaacccccctccaaactgtccagggtcattgatagtccttaaccaggagagagatctgactgtaacagaccaaatcagcccttcccacccaaagaaatggaaccatgggcaaccctaagctccaactactgcaaagactcctccgttatagactaccagtttccagatctctggagcaagcttagtggttacaaagccattctgtctcctttgcactgattagcatctggagcgtgtgaggagggatgatcaagaggcccttcagggagctcgccagccagcctgcgtatcagaatctgagacagcgtgttgacaactttgttgcaaatcacttggcaactcacacatggagtccgcatctcaataagaaccagctaagaaacaacattagacaacaagtcctcaaatcaggaatgttggagtctggtattgaccgaattatttctcaggttgtggacccaaagatcaaccacacattcagacctcaggtagagaaagctgtgcatgagtttttggccacgctaaatcacaaagaggaaggaagtggcaacacagctcccgatgatgagaaaccagacacttcccttattacacaaggtgttcctactcctgggcccagtgctaatgtagccaatgatgccatgtcgatattggaaaccataacttctcttaaccaagaagccagtgctgctagggcttcaacagaaacatcaaatgccaagaccagtgagagagcgtcaaaaaaacttccatctcagccaaccactgatactagtactgacaaagaaagaacttcagaggacatggctgataaagaaaaatctacagctgactctggaggtgaaggactggaaacagccccaaagtctgaagagttcagcgacctcccctgtccagtcgaagaaattaaaaattacacaaaagagcataataatttaattctgctaaataaggatgttcaacaggaaagcagtgagcaaaaaaataaatcaacagacaaaggtgaaaagaagccagacagcaatgagaaaggagaaagaaagaaagaaaagaaggaaaagactgaaaagaaatttgatcactcaaaaaagagtgaagatacacagaaagttaaagatgaaaaacaagcaaaggaaaaagaagtagagagtttaaaacttccttcagaaaagaacagtaataaagctaaaactgttgaagggacaaaagaagatttctctttgatagattctgatgtggatggacttacagacatcacagttagctctgttcataccagtgacctttcatcttttgaagaagatactgaggaggaagttgtaacgtctgatagcatggaagaaggagagattacgtcagatggtaaag

SEQ ID NO: 111618 - DNA, 1128 bp, Homo sapiens
  Payload ID: 1857
  Gene Symbol: BOD1L1
  Gene Name: biorientation of chromosomes in cell division 1-like 1
  ENST ID: ENST00000507943
  CDS Start-End: 1-623
actccaaaacagatactggcattgtcactgtagaacaatctccatctagcagcaaactgaaagtaatgcaaacagatgaatccaataaagaaacagctaacctacaagaaagaagtataagcaatgatgatggtgaagaaaaaatagtaacaagtgtgcgtcggagaggaagaaaacccaaacgttctctcactgtatcagatgatgctgaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagagaaagcaacatagcaagccatctgcacgtgcaacatccaaacttggcagcccagacacagtttctcctagaaatcgccaaaaattagcaaaagagaagttacctaccagcgaaaaagttagtaactctcccccattaggaagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttt

SEQ ID NO: 111619 - DNA, 3239 bp, Homo sapiens
  Payload ID: 1858
  Gene Symbol: BOD1L2
  Gene Name: biorientation of chromosomes in cell division 1-like 2
  Uniprot ID: Q8IYS8
  ENST ID: ENST00000585477
  CDS Start-End: 252-770
atctggagcgcgcttggaatccagcaggcggttgctgccgcgtcttccacaacctccgcggtctggagctggcctcccccaccgccgccccaaccaccggccccgccgccatcaccaccaccgtcacctccgccgctgcctccttggggccctcctccttcaccgcccccttagccacctctacacattctaggctttctgtcctggagaagaagctataatcggtttccttgtgggcccggtgcgcagccatggcggacggtggcggcggcggcagcggcggtgcgggcccggcctcgacccgggccagcgggggcggcggccccatcaacccggcctcgttgccccctggcgaccctcagctcatcgctatcatcgtggggcagctcaagagcaggggcctttttgacagcttccgccgggactgcaaggctgacgtggacaccaagccagcttaccaaaacctgagccagaaagcggataattttgtgtcgacacatctggacaagcaggaatggaatcctccagcaaacgacaaccaactgcacgatggtctgaggcagagtgtggttcagtcagggaggtcagaagctggagtggacaggattagttctcaggtggtggatccaaaactaaaccacatcttcaggccacaaatagaacaaataattcatgaattcctggtggcccagaaagaagcagctgtgccagcactccctccagagccagaaggccaggaccctccagctccgtctcaggacacttcctaagaatatgcctgacagcttttgaaagcgctatttaatttttggtgaagaaatggattcggttacataagagtgcagtttcagattgaagataagccaagttcatcactgagctcaagatttccacctcgaccatgagcagtgaccagattgaaagggaagcaagttcgccagagagaaagttgaccgtggcaccctcctgcattgcgctgccatttggccagcctttccaagggcatgacaccaaacacacactacagagagggaaacactaccgcgacccaggattgtcctgaaacagacatctatacttgaacatggagactgcacatggattttagggtttgtgctctgagataaacgaaagctacagcgagagaacataaccaatcccaaagacaatttcaaagaacaatgacagtaaaggttaactgggaggaatatttgacagtacttatttgatattgtctctcagagttgcaaactagattgtacacaacattagtgtcagatagctttgaagttgtgaccttcttgtacatgaatcttctagccagtttcctttcctttgtaagagataacaaagcatgaaaccctagaatgagtgagaagttcagacattaggtataaggaaactcatttgcagactctctgtccaagaatgcttcctgtcttgcaggggctagtgagtcttgggtgtgtttatgttatgctcacatttgtgttttatttgaaaagtggatggtcaataaatggcttatctttcaactgcaacaacaaaaaagaaatgcagatttacatccttttcctctttaagctccgtcagttttctgatatttctagaaggtcagacacctggcatggtttatgaggcccgtgataatggggcccctggtcacctctgctgccccgtacactgtcatttctcatatgacaaccatgcccatgactatcctggacaccctgtgttccctctgctcactgtgaagggaatgccctcaaccactcctaccctcctttaagactcagctcctgaggagccacacatcgtctaagcaggagtgacagactccttcctctgtgctcccatagatctcataagggatgaccacacttactatagtagctaggtctgacgaagcacttgctctattgctctacagctggcagtgtactaaacgcttaacttcgcttaccgtagtaagtcctcatgatctaattgaagaaatcgtatctttattcccatttttattcccatttataaatgtagaaaccaaagctcagacactgcctaagtggtggggctggggctgagcctgtattgagcacagagccctcacttttaacccttttaaccatgcttttagccacaccacctcaccacagtgaactgtctttgcttacagatctgtcatccccacttaaatgtgagcttcctccagggcagggatttgctttgttcatttcttttccttaaccccaggacctagcacatcacaggagctcagcaatttgtagaaagaaaccagttctggatttgtcttttccaacatttaatttctcagatggcagtatttatcatctaaaaagtgaacaaaaattaattttgcatctagtgtctacatgtctaagcaagaaagagctttcttatccctggaggtattttatctgtaatgtttacctatgagctattttaaatgattcttcaaaatttagagtccagaaggtagaagaccatgtcctttctgaaaatgtcccttcctttcccaggtaccaggctctttttaaaattagcttctgaatatgaacaacccagctctttaaagtttaatgtcccagccattttaattgtttctttcgaagtacaaaagagcagctgggccacatcggcactaatcacttgccaactttcctttttacaaaaacagctaagctctttctgagatttaaaatcactccatctgagaccccagcttggcacctatctttgcactaacataaaaggaacctaatttctgcttttaagaaatgtgttgcggaagtgatttttggtttggggtttgttctccttcttctttttaaaaataacgtaataaagtgtaatacaacttttaaagttttttttttcctttaccagttctctattctccttttctacttgaattgtcctgagacaggttgccagataaaatacaggttgctcagcaaatgtgaatttcagagaaacaacagatactctcctagggcatggaccgtgcaatatttgaaacatacttgtattaaaaagttatttgttgtttatttgaaattcaaatttactggggccccatgctttagtttgccaaatctgccaaccatagcctgaatgcttcccgttcccaccatgagtttggcaaatggaaaatgctaacctatgcgatggacactgctgtattctgaaaatgaatatgtaaataaatcaaactaccgtga

SEQ ID NO: 111620 - DNA, 2075 bp, Homo sapiens
  Payload ID: 1859
  Gene Symbol: BTD
  Gene Name: biotinidase
  Uniprot ID: P43251
  ENST ID: ENST00000303498
  CDS Start-End: 110-1741
agcaggagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaa

SEQ ID NO: 111621 - DNA, 2261 bp, Homo sapiens
  Payload ID: 1859
  Gene Symbol: BTD
  Gene Name: biotinidase
  Uniprot ID: P43251
  ENST ID: ENST00000383778
  CDS Start-End: 359-1930
agttggacttggggagggctgcgcaaaggctgccgggagctgggaagcccggcgcgcgtcgtttgctggggctgtttgtgcgttgctgctgtgctaccgcgttgcgttttctaggcatttacttacacgctttgtggtttacgctctcataaccttgtggttttatagtccttaaattattgtagcgcacgttacttaaatccagaagcagatgtgtaccccagcaagagataaaatgacgctcagagtcagtagatccagaccgtgcctgagatcctgaatcctgtttcctacccactattcagccattgggtcacaagcgatgaaaagagcaccttgaagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccac

SEQ ID NO: 111622 - DNA, 1820 bp, Homo sapiens
  Payload ID: 1859
  Gene Symbol: BTD
  Gene Name: biotinidase
  Uniprot ID: P43251
  ENST ID: ENST00000449107
  CDS Start-End: 89-1726
cacttcccgggagaggtgagaatgtaaacacgcgcgttctccaatcagaactgcgctctcttctcggctcctccattcgcgcgccagaatgccagagggaggcgggactagcaggagattgctgcctatgcaaagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgcctt

SEQ ID NO: 111623 - DNA, 1112 bp, Homo sapiens
  Payload ID: 1859
  Gene Symbol: BTD
  Gene Name: biotinidase
  ENST ID: ENST00000436193
  CDS Start-End: 359-1112
agttggacttggggagggctgcgcaaaggctgccgggagctgggaagcccggcgcgcgtcgtttgctggggctgtttgtgcgttgctgctgtgctaccgcgttgcgttttctaggcatttacttacacgctttgtggtttacgctctcataaccttgtggttttatagtccttaaattattgtagcgcacgttacttaaatccagaagcagatgtgtaccccagcaagagataaaatgacgctcagagtcagtagatccagaccgtgcctgagatcctgaatcctgtttcctacccactattcagccattgggtcacaagcgatgaaaagagcaccttgaagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcct

SEQ ID NO: 111624 - DNA, 499 bp, Homo sapiens
  Payload ID: 1859
  Gene Symbol: BTD
  Gene Name: biotinidase
  ENST ID: ENST00000427382
  CDS Start-End: 324-499
agcttccgtaggagcctttcattccaggaaggtccatcgtacttgcgttttcagggcctgagcgatgactttagcaccagacacctgctcctcgctgcgctctgcgaagttactgtccggcatcttccaccgaaaagctctaagcactcacgcagccggcaaacaagcggaatcatccagcaaggcaaacgcgaaatcggcagcacgccacctctggtactgcacctctgacggacaggagggcaaccaactgccttaaacaacgggaaggaagaggcggtctaaattcgtccacttcccgggagagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccg

SEQ ID NO: 111625 - DNA, 2097 bp, Homo sapiens
  Payload ID: 1859
  Gene Symbol: BTD
  Gene Name: biotinidase
  Uniprot ID: P43251
  ENST ID: ENST00000437172
  CDS Start-End: 233-1870
attgtctccgagtcggccagctggagcgttttcggggctgtaaagggagaatggcgcatgcgcatattcagggcggaaggcgcgctaagagcagacagatttccccacgcagacgctgtgtgtcacagggggaatgggcagcgtcactttttacatccagtcatattgtatgaaattgcaacaaattcaaaaagatgccatcgtgggagtgtgaagacactattgtaatagcatggctaggaaggaaacacagctaattattaagatgaatcatttagcaagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcac

SEQ ID NO: 111626 - DNA, 541 bp, Homo sapiens
  Payload ID: 1859
  Gene Symbol: BTD
  Gene Name: biotinidase
  ENST ID: ENST00000417015
  CDS Start-End: 19-213
gttttcagggcctgagcgatgactttagcaccagacacctgctcctcgctgcgctctgcgaagttactgtccggcatcttccaccgaaaagctctaagcactcacgcagccggcaaacaagcggaatcatccagcaaggcaaacgcgaaatcggcagcacgccacctctggtactgcacctctgacggacaggagggcaaccaactgccttaaacaacgggaaggaagaggcggtctaaattcgtccacttcccgggagaggtgagaatgtaaacacgcgcgttctccaatcagaactgcgctctcttctcggctcctccattcgcgcgccagaatgccagagggaggcgggactagcaggagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcagatttgtggtctgcattatgtctggagccagaag

SEQ ID NO: 111627 - DNA, 797 bp, Homo sapiens
  Payload ID: 1860
  Gene Symbol: BPHL
  Gene Name: biphenyl hydrolase-like (serine hydrolase)
  ENST ID: ENST00000380368
  CDS Start-End: 213-797
ggatccacgtcccacgggccggacccgcggccgcgttcggaaatcagcctgagcctgagtaccgctaaggctttaatcacgggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcagcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatggatggagtctcactctgtcaccaggctggaatgcaatggcatga

SEQ ID NO: 111628 - DNA, 1050 bp, Homo sapiens
  Payload ID: 1860
  Gene Symbol: BPHL
  Gene Name: biphenyl hydrolase-like (serine hydrolase)
  Uniprot ID: Q86WA6
  ENST ID: ENST00000380375
  CDS Start-End: 132-956
ggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcagcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaa

SEQ ID NO: 111629 - DNA, 1928 bp, Homo sapiens
  Payload ID: 1860
  Gene Symbol: BPHL
  Gene Name: biphenyl hydrolase-like (serine hydrolase)
  Uniprot ID: Q86WA6
  ENST ID: ENST00000380379
  CDS Start-End: 50-925
gcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcggcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaa

SEQ ID NO: 111630 - DNA, 1186 bp, Homo sapiens
  Payload ID: 1860
  Gene Symbol: BPHL
  Gene Name: biphenyl hydrolase-like (serine hydrolase)
  Uniprot ID: Q86WA6
  ENST ID: ENST00000434640
  CDS Start-End: 362-1186
ccgacgcagcgagggcgctatggctggcggcctcgcctcctggaaaggccatggtcgctgaggcgacgagcgagggcggggcagcgccgacggggacactcatcccgggagccagagccagcaccgagaggggacggtctacgcgggtgccggcggttccaggactgcgaaaccacgagccgagtttcgaaatcagcctgagcctgagtaccgctaaggctttaatcacgggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcagcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatga

SEQ ID NO: 111631 - DNA, 1563 bp, Homo sapiens
  Payload ID: 1860
  Gene Symbol: BPHL
  Gene Name: biphenyl hydrolase-like (serine hydrolase)
  ENST ID: ENST00000424847
  CDS Start-End: 366-500
gacgcagcgagggcgctatggctggcggcctcgcctcctggaaaggccatggtcgctgaggcgacgagcgagggcggggcagcgccgacggggacactcatcccgggagccagagccagcaccgagaggggacggtctacgcgggtgccggcggttccaggactgcgaaaccacgagccgagtttcggtcgcccatgggaaagcacccggcagggcgtggcttcggggcggggcgggcagagggcggagcaggatggagaggcgaggtgggcggagcagagggcgtggcttcggggcagagtgggccgggtaccgcgcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcggaaatcagcctgagcctgagtaccgctaaggctttaatcacgggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcagcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaa

SEQ ID NO: 111632 - DNA, 576 bp, Homo sapiens
  Payload ID: 1860
  Gene Symbol: BPHL
  Gene Name: biphenyl hydrolase-like (serine hydrolase)
  ENST ID: ENST00000423798
  CDS Start-End: 1-89
ccgccttgattgtgcacggtgagaaggatcctctggtcccacggtttcatgccgacttcattcataagcacgtgaaaggctcacgatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtctt

SEQ ID NO: 111633 - DNA, 2157 bp, Homo sapiens
  Payload ID: 1860
  Gene Symbol: BPHL
  Gene Name: biphenyl hydrolase-like (serine hydrolase)
  ENST ID: ENST00000430655
  CDS Start-End: 366-500
gacgcagcgagggcgctatggctggcggcctcgcctcctggaaaggccatggtcgctgaggcgacgagcgagggcggggcagcgccgacggggacactcatcccgggagccagagccagcaccgagaggggacggtctacgcgggtgccggcggttccaggactgcgaaaccacgagccgagtttcggtcgcccatgggaaagcacccggcagggcgtggcttcggggcggggcgggcagagggcggagcaggatggagaggcgaggtgggcggagcagagggcgtggcttcggggcagagtgggccgggtaccgcgcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcggaaatcagcctgagcctgagtaccgctaaggctttaatcacgggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcagcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatggatggagtctcactctgtcaccaggctggaatgcaatggcatgatctcagctcactgcaatctctgtctcctgggttcaagcgattgctctgcctcagcctcccaagtagctgggaccacaggcgtgcaccaccacacaggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtgga

SEQ ID NO: 111634 - DNA, 1063 bp, Homo sapiens
  Payload ID: 1860
  Gene Symbol: BPHL
  Gene Name: biphenyl hydrolase-like (serine hydrolase)
  ENST ID: ENST00000433912
  CDS Start-End: 50-685
gcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcggcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatggatggagtctcactctgtcaccaggctggaatgcaatggcatgatctcagctcactgcaatctctgtctcctgggttcaagcgattgctctgcctcagcctcccaagtagctgggaccacaggcgtgcaccaccacacaggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatg

SEQ ID NO: 111635 - DNA, 4155 bp, Homo sapiens
  Payload ID: 1861
  Gene Symbol: BIVM-ERCC5
  Gene Name: BIVM-ERCC5 readthrough
  ENST ID: ENST00000602836
  CDS Start-End: 1-4155
acaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctaatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagaga

SEQ ID NO: 111636 - DNA, 2073 bp, Homo sapiens
  Payload ID: 1862
  Gene Symbol: BLCAP
  Gene Name: bladder cancer associated protein
  Uniprot ID: P62952
  ENST ID: ENST00000373537
  CDS Start-End: 316-579
aggatgggtcctcggccggctcgactagaagactaagggggcgtctccccggcttcctgcggcgtcggtggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacattatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 111637 - DNA, 633 bp, Homo sapiens
  Payload ID: 1862
  Gene Symbol: BLCAP
  Gene Name: bladder cancer associated protein
  Uniprot ID: P62952
  ENST ID: ENST00000397131
  CDS Start-End: 352-615
acataaagccagagacaaggctgaacaggcggcagggccatttggtgagacagtcagctgaccccgtgtagaaagagccctgactcactggggagtgggagaggaagacaagtccgaggccgagcactgcccaccctgacgtgatggcaggggagagcccagggccacggacctggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagct

SEQ ID NO: 111638 - DNA, 566 bp, Homo sapiens
  Payload ID: 1862
  Gene Symbol: BLCAP
  Gene Name: bladder cancer associated protein
  Uniprot ID: P62952
  ENST ID: ENST00000397134
  CDS Start-End: 245-508
tagaccgccagtcttgtgggtccctcgcacagcgcggattttcgggcgggaagaccggaatgcggtttgatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacata

SEQ ID NO: 111639 - DNA, 685 bp, Homo sapiens
  Payload ID: 1862
  Gene Symbol: BLCAP
  Gene Name: bladder cancer associated protein
  Uniprot ID: P62952
  ENST ID: ENST00000397135
  CDS Start-End: 327-590
cttctgggtcaccttaggcgtcgccgggtccccgtcactggggttttccttccgcataccccgggaaggcagggcgcccctgtccggcttcaggtgattgccgtgattggacctagcctgggccttggggggtcccttcccagcccggaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctc

SEQ ID NO: 111640 - DNA, 2036 bp, Homo sapiens
  Payload ID: 1862
  Gene Symbol: BLCAP
  Gene Name: bladder cancer associated protein
  Uniprot ID: P62952
  ENST ID: ENST00000397137
  CDS Start-End: 279-542
atattgtcccttctgggtcaccttaggcgtcgccgggtccccgtcactggggttttccttccgcataccccgggaaggcagggcgcccctgtccggcttcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacattatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 111641 - DNA, 572 bp, Homo sapiens
  Payload ID: 1862
  Gene Symbol: BLCAP
  Gene Name: bladder cancer associated protein
  ENST ID: ENST00000456058
  CDS Start-End: 552-572
cttaccgcgtaggtcgctaaatgcctgggtgatcgtccgcagcggtcgcccgccgcgccccgagtctttgttccctggcaggcgcgggcgcactagggagggtcagcgcgaggaggacggcgcagggaatgggcagggggcgcgcggtgccggcagcggcacttgggcaggcaaggatcgcggcaatcggaataggacgggtccgggaagcggcaatcgcgacgcagtcttgcgggttctaggggcgcgagttgggaaccctctcccacccgaaaccccgtcagacttacctgcagcagcacgcggaagatgtaccagccgatgatgagcagttcagccgaggccgccgccactgccgccatggttccaagaatggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctg

SEQ ID NO: 111642 - DNA, 581 bp, Homo sapiens
  Payload ID: 1862
  Gene Symbol: BLCAP
  Gene Name: bladder cancer associated protein
  ENST ID: ENST00000414080
  CDS Start-End: 396-581
ttcctgcggcgtcggtggcgagctgaggtggaggcaggctgcggcagacggcgacagtggcggcggcgccatggcagggcttgcaggggcgcgagttgggaaccctctcccacccgaaaccccgtcagacttacctgcagcagcacgcggaagatgtaccagccgatgatgagcagttcagccgaggccgccgccactgccgccatggttccaagaatggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctgg

SEQ ID NO: 111643 - DNA, 2205 bp, Homo sapiens
  Payload ID: 1862
  Gene Symbol: BLCAP
  Gene Name: bladder cancer associated protein
  Uniprot ID: P62952
  ENST ID: ENST00000414542
  CDS Start-End: 449-712
aggatgggtcctcggccggctcgactagaagactaagggggcgtctccccggcttcctgcggcgtcggtggcgagctgaggtggaggcaggctgcggcagacggcgacagtggcggcggcgccatggcagggcttgcaggggcgcgagttgggaaccctctcccacccgaaaccccgtcagacttacctgcagcagcacgcggaagatgtaccagccgatgatgagcagttcagccgaggccgccgccactgccgccatggttccaagaatggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacattatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttt

SEQ ID NO: 111644 - DNA, 588 bp, Homo sapiens
  Payload ID: 1862
  Gene Symbol: BLCAP
  Gene Name: bladder cancer associated protein
  ENST ID: ENST00000445723
  CDS Start-End: 354-588
ttcctgcggcgtcggtggcgagctgaggtggaggcaggctgcggcagacggcgacagtggcggcggcgccatggcagggcttgcagacttacctgcagcagcacgcggaagatgtaccagccgatgatgagcagttcagccgaggccgccgccactgccgccatggttccaagaatggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcgg

SEQ ID NO: 111645 - DNA, 591 bp, Homo sapiens
  Payload ID: 1862
  Gene Symbol: BLCAP
  Gene Name: bladder cancer associated protein
  Uniprot ID: P62952
  ENST ID: ENST00000432507
  CDS Start-End: 329-591
atctgtaggagggatacaggaaggattggcgcccttcgtatgcacggaaggaatgagctctacggagaagtggttggaatatgcttggggatagttttctgctggacaggtcgtttcgacctcagtcttccgctcccctcccccaagccctggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcaccta

SEQ ID NO: 111646 - DNA, 2365 bp, Homo sapiens
  Payload ID: 1863
  Gene Symbol: BLMH
  Gene Name: bleomycin hydrolase
  Uniprot ID: Q13867
  ENST ID: ENST00000261714
  CDS Start-End: 176-1543
agcctcagcctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaataagctga

SEQ ID NO: 111647 - DNA, 1483 bp, Homo sapiens
  Payload ID: 1863
  Gene Symbol: BLMH
  Gene Name: bleomycin hydrolase
  ENST ID: ENST00000578090
  CDS Start-End: 31-246
accgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaaga

SEQ ID NO: 111648 - DNA, 788 bp, Homo sapiens
  Payload ID: 1863
  Gene Symbol: BLMH
  Gene Name: bleomycin hydrolase
  ENST ID: ENST00000581037
  CDS Start-End: 1-788
gtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataaggttgtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggt

SEQ ID NO: 111649 - DNA, 561 bp, Homo sapiens
  Payload ID: 1863
  Gene Symbol: BLMH
  Gene Name: bleomycin hydrolase
  ENST ID: ENST00000580709
  CDS Start-End: 360-561
agcaacgcgaggggggagttttgtccctccgcggaccccgtttctcccagcctcagcctccccgccgccgccgccgccgccgccgccgagccggtttcctttttccggcgctccgggtgcgagagacaggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggata

SEQ ID NO: 111650 - DNA, 586 bp, Homo sapiens
  Payload ID: 1863
  Gene Symbol: BLMH
  Gene Name: bleomycin hydrolase
  ENST ID: ENST00000577290
  CDS Start-End: 176-457
agcctcagcctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcaggtgtgggcttccacttctcccatacgttccttgaccttcctgacagcgtcccattttggtgtcttatttaagagtggtcttaaattcgtactgaaagaactggtcgtaaattcgtaaagaatgaggcacagggcgatgctggatcttttcttgtctgaatgttatgaggcttccattcatgaaaaagttaaatattgaag

SEQ ID NO: 111651 - DNA, 1020 bp, Homo sapiens
  Payload ID: 1863
  Gene Symbol: BLMH
  Gene Name: bleomycin hydrolase
  ENST ID: ENST00000584603
  CDS Start-End: 67-1020
gagggagacagctccttggaggaggatgccgcttatgggtttccccgctgcagcgggcaccccaggatgcgcttacgaagactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataaggttgtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagag

SEQ ID NO: 111652 - DNA, 823 bp, Homo sapiens
  Payload ID: 1863
  Gene Symbol: BLMH
  Gene Name: bleomycin hydrolase
  ENST ID: ENST00000577623
  CDS Start-End: 130-823
cctaggcagcgagccgcagcgcaatcccggcgctcgcccaaggaccctggaagctaccgttaccccgccgggcagcgtgggcgccatgagcagctcgggactgaattcggagaagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggtgagc

SEQ ID NO: 111653 - DNA, 2606 bp, Homo sapiens
  Payload ID: 1864
  Gene Symbol: BLK
  Gene Name: BLK proto-oncogene, Src family tyrosine kinase
  Uniprot ID: P51451
  ENST ID: ENST00000259089
  CDS Start-End: 593-2110
ctgccctggtgcacacagatggcacatggcagagcccaagccctctccatgagatctgcagcgtttgtccacacggcagggcaaattaccttgtagagtcagcatggaggtttgctaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgccacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcaggatctgaagagctatggtgaaacaccactgaagcattgccaaggatggggctggtaagtagcaaaaagccggacaaggaaaagccgatcaaagagaaggacaagggccaatggagccccctgaaggtcagcgcccaagacaaggacgccccgccactgccgcccctggttgtcttcaaccaccttactcctccaccgcccgatgaacacctggatgaagacaagcatttcgtggtggctctgtatgactacaccgctatgaatgatcgggacctgcagatgctgaagggggagaagctacaggtcctgaagggaactggagactggtggctggccaggtcactcgtcacaggaagagaaggctatgtgcccagtaactttgtggcccgagtggagagcctggaaatggaaaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctaagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggttactacaaaaacaacatgaaggtggccattaagacgctgaaggagggaaccatgtctccagaagcctttctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggggccaagttccccatcaagtggacagccccggaagccatccacttcggggtcttcaccatcaaagcagacgtgtggtcgtttggagtcctcctgatggaagttgtcacttatgggcgggtgccatacccagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcagggggtccccggacggactccttcaccgactgcacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagcaggggcagccccagcctaggctgcgctccagcactgcggggcttttctgcaataaagtcacgagcgttcgagctgt

SEQ ID NO: 111654 - DNA, 2017 bp, Homo sapiens
  Payload ID: 1864
  Gene Symbol: BLK
  Gene Name: BLK proto-oncogene, Src family tyrosine kinase
  ENST ID: ENST00000529894
  CDS Start-End: 293-1597
ccgggggtgctgccacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcaggatctgaagagctatggtgaaacaccactgaagcattgccaaggttgtcttcaaccaccttactcctccaccgcccgatgaacacctggatgaagacaagcatttcgtggtggctctgtatgactacaccgctatgaatgatcgggacctgcagatgctgaagggggagaagctacaggtcctgaagggaactggagactggtggctggccaggtcactcgtcacaggaagagaaggctatgtgcccagtaactttgtggcccgagtggagagcctggaaatggaaaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctaagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggttactacaaaaacaacatgaaggtggccattaagacgctgaaggagggaaccatgtctccagaagcctttctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggggccaagttccccatcaagtggacagccccggaagccatccacttcggggtcttcaccatcaaagcagacgtgtggtcgtttggagtcctcctgatggaagttgtcacttatgggcgggtgccatacccagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcagggggtccccggacggactccttcaccgactgcacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagc

SEQ ID NO: 111655 - DNA, 549 bp, Homo sapiens
  Payload ID: 1865
  Gene Symbol: BORCS5
  Gene Name: BLOC-1 related complex subunit 5
  Uniprot ID: Q969J3
  ENST ID: ENST00000298571
  CDS Start-End: 35-481
ccgccgttcttctgctgccaccgctgtcggcaccatgggcagtgagcagagctccgaggccgagagccgacccaacgatctgaactcctcagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaagg

SEQ ID NO: 111656 - DNA, 4840 bp, Homo sapiens
  Payload ID: 1865
  Gene Symbol: BORCS5
  Gene Name: BLOC-1 related complex subunit 5
  Uniprot ID: Q969J3
  ENST ID: ENST00000314565
  CDS Start-End: 332-922
gagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagtttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagactaaaagtcagagctgaagggagtcgctggggccaggacggcatgcaggcctgtaccctgttccctaagttcctgcaagcgtcgggaggtgtgttttcagataccagaaagagccttcagtagattcacaagattaaaattgatgcgcttaatttaatgtatcttggctaaacttgatctgattctaatcttggtttgagacagggtcttgtgctgttgctcaggctggagtgcagtggcgcaatcatagcacactgactcctcaaactcccgggctccggggatcctcacgcctcagactcctgagtagctgggattacaggtgtgtgccaccaaatccagctaattaaaaaaaattaattaattttacattttcaaattcaaaagaataatacaatgaatattcatatttctttcacctagattgacaaaaagtggtatatttaagacatcaccatcattgtctttcttctggagtatacagaacctggttctgaacacagggatatgtttgtagcttcgaggaatgaagggctgtttacagagctacaaaaatagcttaggtgccattatcctcactgcacttaatacaggtgacacatgaaagcacagagtgggtggcagttcaagcctgcgagggccgagcctttccactgctgcagctgttagtggctggcacagggcaggatggcagacctagtgcagcacaaacaaaccacgcagtcagccagctctccagccaactgtgtctacttctaaagtagaagttagacaaaacatggggttcacttagactggggtcctgagtaggtgataggctacttattactgggtggaagcggagaagtatggcagaagaacaataggcaaattcaatactcccggaaagaattctagttagtttaatattttgatggcatgttgtggtttctgcagtgtcgtgaacttggctaaactgaactgtgttcccagaattcccttccttgtttgtttctctggtgagggttggccacgagagagatttgcatgaggtttggaagtggaagtagagcaacagccatgtgtattcactggaagtggatgtaggtcaggccctgttccatcacgtgcacgttaccatggatctcctgcacttgtggtgtgggcagccgctgggcccacggctcctcccactcccgcagaactctgcctttggcttttccagaccctgggccgggtatgagaaccagcttcttggtctgcagccacaaggatgaaggtttggggatgagagaccagcacgggctctgatgagagacaggtgcaggtcccagcttgtggcttgcaggtctcagtcgtacttgctctccctcaccatcctttccaaccgcctggcctgtggtctggtgaagaagaaacagccgaaccgagactttcaccagcccctctaattgctcaaaccgctttcacaatcctctctttctacatcattcctagtggttcttttctgatggaacctctgactggtaacatggcattaccagtcctttccctctcatgttttgctatttcctgatggaacctgggagtctgagtgatttgtatttcaagaagcagttatgctggatctctttgttggttaataccccatgacctatctggccgttatgggatatttcagggataggagttgtgaaagagcccttggctggacgtttctagccttaatctttggcaagccatttcatttccctgagcctcagtttccgccttcctacagcgtgagcaggtctgggtgggctctcaagcccctttcagctctaagattccaagtctgtgattccgatacatcttgactacaatgagcgtgtttaccttttgtctctgagcagtggccctgggtcttggtagtgactaaattccgagctcccaaggtgcagctgcttttcttccttttaattataaattagctgttcattggctgcttctttctagagcctgttttgcttatcttgcaatctgttcatttctgttgatgaacacagtcaaataggcctctatgtgcagtctcctggtttccctggtcaaagtggaaggttggtagaaactggccttcatgtctttgtttccctcaaagttttattcttagtaacgctatatatggttttatagaccacacatatatagtttcctgtgtcttagatgataacatccttaaaatatgaaatatattttgaacctagatacctacccagtattctctgcacagagtaaacatttcattaaatgagtttcaaggactccataccctgatataggagtacattcaagaaatgagtttaggccgggcgcggtggctcacacctgtaatcccagcactttgggaggccgagacgagtggatcacctgaggtcaggagttccagaccagcctgaccaacatggtgaaaccccatctctactaaaaaaaatacagaaattacccgggcatggtggctggtgcctgtaatccccgctacttgggaggccaaggtgggagaatcgcttgaacctgggaggcggaggttgcagtgagccaagttcgtgccattgcactctggcctgggtaacaagagtgaaactccgtttagaaatgagtttagtctgggagaatctgctttttgagtaaaaaagtttgattttatgtatgtgtgcgtctgtatatatgtttctgtatcctgagtatttctttgcggcttcttcagttatgaaagaggttggtactgttacccttacgttataggtattacaaactcggttttacaaggttacataaactaatggccctggggcgaatgacgtatgccacttttgtgttgatttgtagaacttacttagctttggcatttcccctagtaattcccaaggcaaaaccaggaattgtcagagacgtgaccagacatgtattaaaattctagtgcaattggg

SEQ ID NO: 111657 - DNA, 580 bp, Homo sapiens
  Payload ID: 1865
  Gene Symbol: BORCS5
  Gene Name: BLOC-1 related complex subunit 5
  ENST ID: ENST00000542728
  CDS Start-End: 40-573
tctgcgtcccggaaggagcgagcttgcggagcgtgaaccatgactccttcaccagccaagcatagagccaagatggatgatattgtggttgtagctcagggctcccaggcctcacggaacgtcagcaacgatcccgatgtcatcaagttgcaagagattccaaccttccagccccttttgaaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgc

SEQ ID NO: 111658 - DNA, 580 bp, Homo sapiens; identical to SEQ ID NO: 111657
  Payload ID: 1865
  Gene Symbol: BORCS5
  Gene Name: BLOC-1 related complex subunit 5
  ENST ID: ENST00000625206
  CDS Start-End: 40-573

SEQ ID NO: 111659 - DNA, 4840 bp, Homo sapiens; identical to SEQ ID NO: 111656
  Payload ID: 1865
  Gene Symbol: BORCS5
  Gene Name: BLOC-1 related complex subunit 5
  ENST ID: ENST00000627374
  CDS Start-End: 332-922

SEQ ID NO: 111660 - DNA, 549 bp, Homo sapiens; identical to SEQ ID NO: 111655
  Payload ID: 1865
  Gene Symbol: BORCS5
  Gene Name: BLOC-1 related complex subunit 5
  ENST ID: ENST00000627461
  CDS Start-End: 35-481

SEQ ID NO: 111661 - DNA, 2575 bp, Homo sapiens
  Payload ID: 1866
  Gene Symbol: BORCS6
  Gene Name: BLOC-1 related complex subunit 6
  Uniprot ID: Q96GS4
  ENST ID: ENST00000389017
  CDS Start-End: 768-1841
tctcaatcataacactttatttcctgtatagcacatatcaaaatttgtgatcatttcatttgttgaatattttacctcgtggcaaaatcacacgccatcctccaaggggcgagacccctcagtgtgaaaggggcaagagacacagaacaagagtgacaaacgcataggaaagcccagaggccgctgccttgaccacagtgggtcgctctgagcagttcagtggttaggtctcttaaccaagaaagatagagcaaaccattcatgctcatgctggacttctggtttccttctttttagtcaactaggttcaaccctgatggtccaagaaggatatgccattttcatcctaagaacctctctaggaaccccaagtgggctccccacttggtatttttgctaagcaatcactgttggggggggtacaattacaggcagaaaggatctgagccccacccctcgggactcaggaatttgaggaccttggtctttaagatctgccccatcagctttcagaaagggcggggcgacgggagcagctgtcacctccttctctccaccctgccggcgttcacgtgtgttccgctgtgcagtaacagctcttcttccgggacttcctggtcgccgcgaccaatcaaaatgcttttcctgtccttaccattgtcagccgctgccaatcggctcgcctctaccaacgccccttaaaggcgcagccactgcctccggagccggggcgaaccaattcctccgttgcggcccccacctgcagtatggagtcgtctcgggggcggcccgggcccgagacggaccttctggctgtagcggaacatcaggccctagtctttggcggcgggccgggccgaacgtcctctgagccgcccgcaggcctccgggtgtccggggaggaagagaccgagaacgttgggggcgcgaaccgccaccccaggacgtccccgaagacgtcaagctgcggcgtcgtccaccggccggaacgggaggctctggagaacgagcccggccctcaagggacgctgtctggggccgggagccgcaggggggcgccgggtgcagagcacgaaccttccctgtcctcccggcacaagaacccggcgccgcccgagggcaagccctcctccgggagggactgccgtcgagggggaccaggcggcgggatggatgttgagcagcaggaggaggaagacaacgacgaggaggcggccgcgggcagcagagccggccgctcgttctccagccgtcttcaggacagccgcagcctggacgggctgagcgaggcgtgcggtggcgccgggtcctcagggagtgccgagtccggcgcgggcggcggacgccgcgccaccatctccagtcccctggagctcgaaggcacagtgagccgccacggcgaccttacccactttgtcgccaacaacctgcaactcaagatccgtctgagcggcgcgcctccacccccgccttctgcccctgcgcggccctgcccagcgcctgcacccacacccacaccggccattcccccaatcgaccccgaggtgctgcgggatctggagcggttgagtcgggagctgggaggccgggtggaccgtctgcttcgcggtctgggtggcgcggtgcaggagctgacggcgctgagcgtgggttgcatccagacctaccgcgatgctgtggactccttaggtgaagccgtggacatgagcatcaagggcatgtacaccctgctggcgcgctgcgaggagctggagcgggctctgcagccggttcaggggctggcgcgccaagtccgggatatccgacgtactctggaggtgttggaggccctgtgcaagtgaccaggaggacaggagaggccggtcctggccagggcagggcccagcaggaccctaaggactcttcagggagtcctggtgggaagtgcccactgaggggaggcctgtgtgttggaggctcttccagatgcgttcagctggcccgtgcccactcgctgggccttaggctggtgtatgtggggaagttctaacggctctcctggtgggaagggatgttgctctgcttgtattcagttggccatctgtagctaccctgttcttcccaactctcctccctagctagagcaccagccctgggaacacggggctttaggtctgcttgaaggtgaggacgtgactcccacatgtaatcaggagaaagggacagaggaagccccagcccccactgtggctatcctgactccagtggccacatctcaggtgccaggggctgtgggagcttgtgccgtccttggccaaacaccccgcaggcaaagatgcacccctgctgatggagagccttctgcttctgccctctggccctctaccataccacttccccagccagaaccggcgtgcagctaggaggaatgggttgcacggcggagggggtgaggtgggaggcgtctcactgctctcagggttcaggtagaatgttgctggttttgaagctcacctgttgtggagtgttctaatcagttttggctttctgagtttttgtggaattaaagtgctgctgctgcgaaggctgaggctga

SEQ ID NO: 111662 - DNA, 2422 bp, Homo sapiens
  Payload ID: 1867
  Gene Symbol: BORCS7
  Gene Name: BLOC-1 related complex subunit 7
  Uniprot ID: Q96B45
  ENST ID: ENST00000339834
  CDS Start-End: 65-385
gctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagttagaaaagttctgtgttagggccgggcgcggtagctcacgcctgtaatcccagcactttgggaggccgaggcgggtggatcacgaggtcaggagttcgagaccagcctggccaagatggtgaaaccccgtctctactaaaaatacaaagaattagctgggcgtggtggcgggcgcctgtaatcccagctactcgggaagctgaggcaagagaatcgcttgaacccaggaggtggaggttgcagtgagccaagatcgcgccactgcactccagcctgggcgacagagtgagattccatctccaaaaaaaaaaaaagaaaaaaaaaagaaaagttctgtgttgatgtacagtttctcctaagaagaagcgaggtggttgaattttggaagcacttcttgaatcggattaacccatgctcttattgaattttttcatctgctctgtttagtttgatattaaagcaaaattaagaggtcttagtttttcctatagaacttttaatatgtcaaaagctatattgtctaaatttcagtacttaagcaaatactgagtagtgttttaaattcagaaatagagcttctattatgaacacatgagaatgatttttttctcttaatcattattaaggaaatattttaatttcatggtcatataatggtgataagtaatacctgattgtttccttttctgttctagtaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgttagaacaggtggaaatgtatacattatttgatggtttgtttttttatggaaataaacaacatacatagaattaaatggtgatcaaaaacatggaaaaaatacttcactaaataacgtctaagttgtagaggttgtgccggaagataatatttttaaaataacaaatgttcaaatgccataaaagaaaatttgtgtgataataccaaagcagtactataagaaaataagcatgctttaaatccct

SEQ ID NO: 111663 - DNA, 838 bp, Homo sapiens
  Payload ID: 1867
  Gene Symbol: BORCS7
  Gene Name: BLOC-1 related complex subunit 7
  Uniprot ID: Q96B45
  ENST ID: ENST00000369883
  CDS Start-End: 26-346
agtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacattaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaa

SEQ ID NO: 111664 - DNA, 1489 bp, Homo sapiens
  Payload ID: 1868
  Gene Symbol: BORCS8
  Gene Name: BLOC-1 related complex subunit 8
  Uniprot ID: Q96FH0
  ENST ID: ENST00000477565
  CDS Start-End: 473-802
acgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccaggtaaacatggcagacaagagcatgtcagatgcgctgtgaagaacactgcggggcccctcctaggaggtggcatgagttacatgcagacagagacgatccgggggcagacggagttccatgtggggcagtggtgagggcagacgctctggggctgggatccctgggagtgttcgagaagcaccgagaaggcttctgtggctggagccggccagctgggggagatggggccagggagatggcaggggcctctccctgtcccaggacccagagccaagggaggctttaagcccaggaccaggggtctgaaaacgaaaagcactcacagtccttgaacattggaaagagaatttttgaagagtagcccttctttttgtttttgttggcattctaagttaataaacacgcttatgaa

SEQ ID NO: 111665 - DNA, 1429 bp, Homo sapiens
  Payload ID: 1868
  Gene Symbol: BORCS8
  Gene Name: BLOC-1 related complex subunit 8
  Uniprot ID: Q96FH0
  ENST ID: ENST00000462790
  CDS Start-End: 473-832
acgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagagacggggtttcaccatgttggctaggctggtctcaaactcctgagctcgtgatcctcccgcctcagcctcccaaagtgctgggattataggtgtgagccaccgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggtttgagatggacacgtgacccaatgagcgacctttcctgggagttctaccaggagcatcaggaaggttgagctgggtgtatgggaaccaggccggggcgaggggttccggggggacctgagaacattgtgtggagccctggatccaactgtacctgacactagccaatttcatttcttcagtttcatggacccctaaattatgatttttgccaaaa

SEQ ID NO: 111666 - DNA, 457 bp, Homo sapiens
  Payload ID: 1868
  Gene Symbol: BORCS8
  Gene Name: BLOC-1 related complex subunit 8
  ENST ID: ENST00000588208
  CDS Start-End: 1-210
gcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccaggttcctagtgattggtttgagatggacacgtgacccaatgagcgacctttcctgggagttctaccaggagcatcaggaaggttgagctgggtgtatgggaaccaggccggggcgaggggttccggggggacctgagaacattgtgtggagccctggatccaactgtacctgacactagccaatttcatttcttcagtttcatgga

SEQ ID NO: 111667 - DNA, 3149 bp, Homo sapiens
  Payload ID: 1868
  Gene Symbol: BORCS8
  Gene Name: BLOC-1 related complex subunit 8
  Uniprot ID: Q96FH0
  ENST ID: ENST00000488252
  CDS Start-End: 296-655
gaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccaggtcagtgccgagggtagccacgagcctctctctctgctctgaactaaccaacccgcccgcttggcagccaggcaggcacctgcttgtctaaccacttggggtttctcactgggcttgtgggatgatttcggaggtggcaggtggaggggtgtctgcaggtccagaatgttccaccctgctgctcagggaccatgtcagcccatctctcccactctctctccaccaccttcctctctcttttccaggccataggccccatgctagtcccagagatttccaccccccaagacagagaagggagcccacatttcctctatcctaccacgtgccagcagcctgctttacccgtgcacagtctctcaggcagagcccggcatgggcaattacccacctatctctgggacctccccacccatctactgcctacctgctgtgtgaccgagcaaattcactaccctctctggtctctgcatttactttctgtaaaggtggctctcaggtgaccaagagggtgcagggcacagtgacggatgtgctttggagcagtcggctattgctgcataacacagcatcccaaaacagtggtttacagccccagtaattaacctactcatgattctgcactttgggctgggctcagctgggtggttctgctgctgtccctggggctcacccatgtggtgctcatgggagctcagctgcacctgcatagtcagggggtcccttggccaggactgttggcagcaggggtcagattttcctcatggcctctccagcaggccagcccgggtttctcctggtggctgggagccaggagagcggctcccatgcagagtgctggtttcacatttgtgggtggcccatccgttgaggccagtcacgtggccaggcccaggaccagatgggagaggaccgcacaagtgcagcgtgagctgtgggaggtgtggctgaccacgcttagagagtgtggtgccaggaaagatctgatgtgtcaccattctatatctgtgatgggcagacgcaggcaggtcaaaggggccctggggacttaccgagcccctgcctattggccaggcactgtgattgtcctcggtgccatgtgccatggaagccctctcagaggtcgaggggaggcaggtggagacagagcctctgtaggcctttcaagctgtagccccagagcccagaggcagccgaattcatgtgtgcagtcagagagcacttagtgggcactgtagtcaatcagtgagcgcttactggacaccacaggcagcaagcatttactgagtacctctggcagttgatgcatacttcctgagtacctgttcatagcaggcttagctctggatgtggggtggtgaggaatcccacaggctgaggggtggcctgggagctttccagggggcctgaagcaggaggggctgcctgagtgggtcagcagcccagcccagtgccctacgcagccctgcccacacccccaacccagcctctgtctccccagtcccatcccccacaccctggtccctcctactttgtgcctcgaggacactgccccgctgccctcctcacttcccagcgtctgctgtcccctccgctgctgctgcccggcaggattgctctgtgtctcatccacgtttgtccctgcagagttcctcgcctctccctggaaccgccagcctcatgccgcatctcagaggctttttttttctctcttttttttttttttgagatggagtctcactctgtcacccaggctagagtgcggtggtgcgatctcggttcagtgtaacctctgcctgtcaggttcaagcgattatcccgcttcagcctcccgagtagctgggactacaggcgcacaccactacccccagctaattttttgtattttttgtagagacggggtttcaccatgttggctaggctggtctcaaactcctgagctcgtgatcctcccgcctcagcctcccaaagtgctgggattataggtgtgagccaccgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggtttgagatggacacgtgacccaatgagcgacctttcctgggagttctaccaggagcatcaggaaggttgagctgggtgtatgggaaccaggccggggcgaggggttccggggggacctgagaacattgtgtggagccctggatccaactgtacctgacactagccaatttcatttcttcagtttcatggacccctaaattatgatttttgccaaaatgg

SEQ ID NO: 111668 - DNA, 801 bp, Homo sapiens
  Payload ID: 1868
  Gene Symbol: BORCS8
  Gene Name: BLOC-1 related complex subunit 8
  ENST ID: ENST00000585679
  CDS Start-End: 149-337
ggttcgctcggccgcggtcgctatggaggagccggagatgcagctcaaggggaagaaagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagagacggggtttcaccatgttggctaggctggtctcaaactcctgagctcgtgatcctcccgcctcagcctcccaaagtgctgggattataggtgtgagccaccgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggtttgagatggacacgtgacccaatgagcgacctttcctgggagttctaccaggagcatcaggaaggttgagctgggtgtatgggaaccaggccggggcgaggggttccggggggacctgagaacattgtgtggagccctggatccaactgtacctgacactagccaatttcatttcttcagtttcatggacccctaaattatgatttttgccaaaa

SEQ ID NO: 111669 - DNA, 3030 bp, Homo sapiens
  Payload ID: 1869
  Gene Symbol: BLOC1S5-TXNDC5
  Gene Name: BLOC1S5-TXNDC5 readthrough (NMD candidate)
  ENST ID: ENST00000439343
  CDS Start-End: 1-411
gggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttt

SEQ ID NO: 111670 - DNA, 2303 bp, Homo sapiens
  Payload ID: 1870
  Gene Symbol: BOP1
  Gene Name: block of proliferation 1
  Uniprot ID: Q14137
  ENST ID: ENST00000569669
  CDS Start-End: 1-2241
atggcgggttcgcggggtgcggggcgcacggcggcgccgagcgtgcggccggagaagcggcggtctgagcccgaactggagcctgagcccgagccggagccccccctcctctgcacctctcctctcagccacagcaccggcagcgattctggcgtctccgacagcgaggaaagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccgcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgc

SEQ ID NO: 111671 - DNA, 651 bp, Homo sapiens
  Payload ID: 1870
  Gene Symbol: BOP1
  Gene Name: block of proliferation 1
  ENST ID: ENST00000569403
  CDS Start-End: 1-651
atggcgggttcgcggggtgcggggcgcacggcggcgccgagcgtgcggccggagaagcggcggtctgagcccgaactggagcctgagcccgagccggaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggag

SEQ ID NO: 111672 - DNA, 5567 bp, Homo sapiens
  Payload ID: 1871
  Gene Symbol: BVES
  Gene Name: blood vessel epicardial substance
  Uniprot ID: Q8NE79
  ENST ID: ENST00000314641
  CDS Start-End: 218-1300
gtcgcgatgcctattttagtcaaagcggctgcgggcttggggacccggcccgggcagcggagcttccggacccgccgacccgccgaggagcgcgcgtcgggctcccgtcgagcagctgagcccgtgtgccccgcgtcccgcgccccgaagctgccgctccgaactttggtcggcgctgcccaggctccccgccagggaccagccgggaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtggagtcggagggaggaagtgaggaagggtcaaggatggaagagttctttcacttaccctttttattagtcagcttttaaagtaattgttttactgagccttctgactatgccttgttctcttttgagatatatattttcacagtcttttctagatatattattgttttaacttaacaaatcttagcaatctctcaatgccttttcacttatttttttccaagttatgattctttttcctcacagtcttttttgttccatagcaatgaggttgtccatttgataattttaacaaacaatgtaagtttaaaattgaggctaaggtaacatgaaaaagcagggaatctcaaactttattccatatatacacacacacacacacacacacacacacacatacatacatacatatatatatatatatacatatatatacatacacacatacatataattttttttttttttgagatggagtttcactctgtcgcccaggctggagtgtagtggcacattctcagctcactgcaaactccacctcctggattcacgccactctcctgcctcagcctcccgagtagctgggactacaggcacctgccaccgcgcccagctaatttttttgtatttttagtagagatggggtttcactgtgttagccaggatggtctcgatctcctgacctcgtgatccgcccaccttggcctcccagagtgctgggattacaggcgtgagccaccgcgcccggcctattccatatttttttaatgggacattttagagaaaggtgtgatttgactggttttatttttctcccaggccagaagtattactccactagatcaccttacttaattgggcactgtgtggataacttgataatgaacaaaactctcagattttactcacattacccttgtattatgccatttataaactgctctgaaacctgaagctggaaagataacagatgggtttctgagcacggggttaacctccagctaaactcaacttccttgggatttggagtcaccatgttgtgcacactctggtgtgggaaacactttatgtagggtgggaggacaggggagttaaatggctgggcaggtgccacaggatgaggccactgaaagatctgcttcattctttgatctgtattctgaagttccagattgttcatctagaggcagagacatctcttttaaaaaagtgccagatgccccagtgccagagctgcgaacgtgaacacagtggaaggcagagggtttactacaggccaggccatggacaccccacccaggtactgcagtgagggccttgattccagagctctttttcctactgaaatcatggtttagtaaacagtggcatttggctggtgggaaatgcgtaactggtcagtgtgtctggccagcgtggctgtggcacttggccaggacgctccgttgaatgaagctcattgattggccatgctggtcatgtctattttgcttcatccactagaaccaactttgagtcagtctcctgttacgttaaatggctaagaaaagttccaaatgaagttgttctcaggtgaactgagccaaaagaagcaactcttaccatgaggtgatttctgttagaggagacatataaataagctcatctagggtcacctcattttcctaaatatgtttttaaagcaattattgtagtaatttcatttgagttaaatttacatgctcggtcactcattgagaaaatttacacagactctgaatccagttcctgtcatcttcagatgttggtttattgacatcacagtaaaaaggctactgtcgactggacacagtggctcacacatgtaatcacagcactttggggggccaaggtgggtggattgcttaagcccaggagttcaagaccagcctgggcaacatggctaaaccccatctctacaaaaaaaattagctgggtgtggtggtacatacctgtagtcccagctactcagaaggctgaggtgggaggttcacttgaacctgggaggttgaggttgcagtgagcacagatcacaccactgcactccagcctgggcaacagagtgagaccctatttcaaaaaaaggctgctttcactgtactgctgcagcagtctcttcaggtagctaaattaggagcttgttttggagaaatgaagcaaaggtgaatgacagcctaggcttgaaattataaagctctctcaggttgaactctctcgtgcgctctcgctctcactttcgccctgtacctgagagcacaggtgtaactgtgatgtcatagtgccgagactactttcctttaaccattggggttaagttgggcagcccatttagtttacacgcgcataagactaatttacaaaatcactctatacagtcattagatgtaacatccttccctgagtagaaagtaatgcatgtgtttggagattattttctgtaatgctgggaacaaacctgttttaaaagcacactgctaaaagtaggtgatataagaccatttgctgtttttattaaagtatgtgtgtgtatcagtgtctcaatgtgaagattgtaacctcaagattaggaatcttaaaagagccacttagcctgaatgggaaacgtgagactatttttaaacacacacctctaaggaagaagcctcccatatagacttgatctcaaagaagcagataagaagacagaaaagtgttttaagtgtaagatctcctatggagtactttaaattcatttatacaaatgaataagtgtatctttgtataatgcataaatacatagataaaaacatgtttgctgccaaagttcccaataagatgcttcctgtgttttttggcctttacttagctgaatgatcaaagttcagaaaatggtctgcaaaagttactccatatacaaccccaaatctactactttaaatgtaacatcaactcagttgtatgaatctggagtgtaatatttatattagaatgtatatgtcatttaaaatattttgaaagccctcataaatatttatatttactaaactaatagcatagacactatataaatccgcagtgatgcttatatatcttaaattagtaataatgggtgctatataattattttcagttactatccctgacactctggaatcttctccatttctccctatcactcaatttcattttaatcattggacacctttgcgttttgctgctaacagtgtgtgtatgtcaccctctttatatctggttttcccacttgtctgaagctctcctgatcttagaacctggagctgcagattcctccatgtcagctcccatcacggccccaaagacagagtcacttggttgctgagtcacttggttgctggaaaaatctttggggaaagctggtataagctacacactgacctgtccccagtgtttccaggtaatgacttggcactccagagaaagtttcatgctgttgcgtgtggtggctccaagccaagcacctggcatgcaggtcagcccttcccagcgggcgtggcgtcgtcctcttcacagatgccacgttgcagccccaaggcctcaccattttgcgttttttagaaacccattttcttggtcatttataaagctgctttatagatatctttgatcctggcatgccttggtttcctctcccttccctctttccaatcctggtttcctaacctcctcttgtagtaattctcaactcaactcaaagtcccaagaatttggaatggtaggatgctgtgcggggagctcgaggctgaggcataatcactgcttcggttctgctcatcaggggacacgctcccttactcatggcagccatgtttgattgtcacagagccccccgaatactctgtctatagtgacacactgtaggtgtcataaattttaagaaacctgcttttaagtactatttataggtttttctgttatacttgcaacctagttttaaaatacatgaggattttatgaaagctttatacagacatttataggaaactcattctttgattttaggtgccatttaaattgataacacttactttataaaaagatgctttttgtctggatagagccttatagtttaaaatatcttcatatattgccatttgatcaaataaatttcttacttagaaaa

SEQ ID NO: 111673 - DNA, 1663 bp, Homo sapiens
  Payload ID: 1871
  Gene Symbol: BVES
  Gene Name: blood vessel epicardial substance
  Uniprot ID: Q8NE79
  ENST ID: ENST00000336775
  CDS Start-End: 105-1187
gcggccgccgctcaggtcaggcagccccagcgtccccgggccctcggccccaccgagtgccggctcccgcgctctgcggcggcaagccccttggaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtggagtcggagggaggaagtgaggaagggtcaaggatggaagagttctttcacttaccctttttattagtcagcttttaaagtaattgttttactgagccttctgactatgccttgttctcttttgagatatatattttcacagtcttttctagatatattattgttttaacttaacaaatcttagcaatctctcaatgccttttcacttatttttttccaagttatgattctttttcctcacagtcttttttgttccatagcaatgaggttgtccatttgataattttaacaaacaatgtaagtttaaaattgaggctaaggtaacatgaaaaagcagggaatctcaaactttattccatata

SEQ ID NO: 111674 - DNA, 1500 bp, Homo sapiens
  Payload ID: 1871
  Gene Symbol: BVES
  Gene Name: blood vessel epicardial substance
  Uniprot ID: Q8NE79
  ENST ID: ENST00000446408
  CDS Start-End: 160-1242
ggagagcgccgatggctggggacccgaggtccgcgccacccacccgcaacctccttccccgagcctttgggaacgggttgttggccagacaagtcccagaaactgcctgctttgaagcatgaataagtgcgaaaagactcttagcaatgaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtggagtcggagggaggaagtgaggaagggtcaaggatggaagagttctttcacttaccctttttattagtcagcttttaaagtaattgttttactgagccttctgactatgccttgttctcttttgagatatatattttcacagtc

SEQ ID NO: 111675 - DNA, 5258 bp, Homo sapiens
  Payload ID: 1872
  Gene Symbol: BLM
  Gene Name: Bloom syndrome, RecQ helicase-like
  Uniprot ID: P54132
  ENST ID: ENST00000355112
  CDS Start-End: 119-4372
aatcggaataggcaagcttccggcgggaagtgagccagggcttggcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaataagcatgttttgctgccgctgcaagtgttgtggccgttgtttctcagaacgtctgaggcagcagctgaatcatctcagtgcaagagcttctgagcataacacgaaacccagaagccaaaggaagagccacgcgtgggcccttgtgaaactaaagcttttcgtgtaagacaacacaaacaaaatttaaagacaaatgacggggaaaagaggagaaaatatattacaaaggattagtatccatcataccaaatacccgtgaaccagtcagaaacatcccagggggcaggtggaccaaggatgtgaacaggctagtctcagaagaagaaatacacatgctcatggcccggcactgtggctcacgcctgggatcccagcactttgggaggccgaggcaggtggatcacgaggtcaggagtttgagaccagcctgcccaacatggtgaaaccccgtctctactaaaaatacaaaaattagccaggcgtggtgtacaggcacgcctgtagtcccagctactcaggaggctgaggcaagagaatcgcttgaacccaggaggcggaggttgcagtgagccgagatcgtgccactgcactccagcctgggtgacagagcaagactccgtctcaaaaaaaaaaaaaaaaaaagaaatatacatgctctgcaaatatgtgaaaaaggtcaatctccatgaataaaaatatgataaaacc

SEQ ID NO: 111676 - DNA, 4510 bp, Homo sapiens
  Payload ID: 1872
  Gene Symbol: BLM
  Gene Name: Bloom syndrome, RecQ helicase-like
  ENST ID: ENST00000559724
  CDS Start-End: 42-1283
ggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgggtctcactgtgttgcccaggctggtcttgaactcctggacttaagcaatcctcctgccttggcctccccaaagggctgggattacagtcatgagccaccatgcctagccaagacttttttttttttccctcaaagaaaaatattaacaacataattattttatagctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatct

SEQ ID NO: 111677 - DNA, 3966 bp, Homo sapiens
  Payload ID: 1872
  Gene Symbol: BLM
  Gene Name: Bloom syndrome, RecQ helicase-like
  ENST ID: ENST00000560509
  CDS Start-End: 52-3912
cgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgacca

SEQ ID NO: 111678 - DNA, 3428 bp, Homo sapiens
  Payload ID: 1873
  Gene Symbol: BMI1
  Gene Name: BMI1 proto-oncogene, polycomb ring finger
  Uniprot ID: P35226
  ENST ID: ENST00000376663
  CDS Start-End: 506-1486
cagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaagattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaa

SEQ ID NO: 111679 - DNA, 552 bp, Homo sapiens
  Payload ID: 1873
  Gene Symbol: BMI1
  Gene Name: BMI1 proto-oncogene, polycomb ring finger
  ENST ID: ENST00000443519
  CDS Start-End: 1-552
tacttcattgatgccacaaccataatagaatgtctacattccttctgtaaaacgtgtattgttcgttacctggagaccagcaagtattgtcctatttgtgatgtccaagttcacaagaccagaccactactgaatataagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtg

SEQ ID NO: 111680 - DNA, 536 bp, Homo sapiens
  Payload ID: 1873
  Gene Symbol: BMI1
  Gene Name: BMI1 proto-oncogene, polycomb ring finger
  ENST ID: ENST00000442508
  CDS Start-End: 85-536
ccgagaggagtactggtatttccagcctcggcggctctcccggccgcagcgccctttgttgagaggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaa

SEQ ID NO: 111681 - DNA, 406 bp, Homo sapiens
  Payload ID: 1873
  Gene Symbol: BMI1
  Gene Name: BMI1 proto-oncogene, polycomb ring finger
  ENST ID: ENST00000416820
  CDS Start-End: 92-406
gcccgccgaggctcggggctcgggccgggctccgcgcggagttgcagcggtggccggatgccaagtgtaagtgattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgat

SEQ ID NO: 111682 - DNA, 1877 bp, Homo sapiens
  Payload ID: 1874
  Gene Symbol: BAMBI
  Gene Name: BMP and activin membrane-bound inhibitor
  Uniprot ID: Q13145
  ENST ID: ENST00000375533
  CDS Start-End: 557-1339
cgccgctcggagccgccgggcaggtcccccagcgctcgcgtctgggcccgccccccgctgcggggcggattgacaggagcccggcggccaatcggacgccgtggggcggggcgaggcggggcggtgcaggccggctcccggcgcggggcgctatttacggcgcggagccggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagctggaattgagtacctaaataaacaaaaatgtgccctatgtaagcttctacatcttgatttattgtaaagatttaaaagaaatatatatattttgtctgaaatttaatagtgtctttcataaatttaactgggaaacgtgagacagtacatgttaattatacaaatggccatttgctgttaataatttgttctcaactctaggatgtggcttggtttttttttttctcttttcttttttaaacaagaccaagatcttgcttattcttccatg

SEQ ID NO: 111683 - DNA, 5031 bp, Homo sapiens
  Payload ID: 1875
  Gene Symbol: BMPER
  Gene Name: BMP binding endothelial regulator
  Uniprot ID: Q8N8U9
  ENST ID: ENST00000297161
  CDS Start-End: 375-2432
ggacagtggagacgcgccttctcggctctggtccgcgccctggggccctggcctccctggaggggctggggaactggaagctgggccgagagagttcccgctgcagctatcgcgcagtccctcctgcgcccgggcgcccccagcgggttccgggaggcgcccggtgagcccacgtctgttgcggcggagcgagcgcgctccgggagggccgagagccggcggggctggcaggagctctcgggcgcccgcctccctccttcgcggacggtctcccgacacgccggctgagagcccttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgaacaaggaagtgacatgtaagagagagaagtgccccgtgctgtcccgagactgtgccctggccatcaagcagaggggagcctgttgtgaacagtgcaaaggttgcacctatgaaggaaatacctataacagctccttcaaatggcagagcccggctgagccttgtgttctacgccagtgccaggagggcgttgtcacagagtctggggtgcgctgtgttgttcattgtaaaaaccctttggagcatctgggaatgtgctgccccacatgtccaggctgtgtgtttgagggtgtgcagtatcaagaaggggaggaatttcagccagaaggaagcaaatgtaccaagtgttcctgcactggaggcaggacacaatgtgtgagagaagtctgtcccattctctcctgtccccagcaccttagtcacatacccccaggacagtgctgccccaaatgtttgggtcagaggaaagtgtttgacctcccttttgggagctgcctctttcgaagtgatgtttatgacaatggatcctcatttctgtacgataactgcacagcttgtacctgcagggactctactgtggtttgcaagaggaagtgctcccaccctggtggctgtgaccaaggccaggagggctgttgtgaagagtgcctcctacgagtgcccccagaagacatcaaagtatgcaaatttggcaacaagattttccaggatggagagatgtggtcctctatcaattgtaccatctgtgcttgtgtgaaaggcaggacggagtgtcgcaataagcagtgcattcccatcagtagctgcccacagggcaaaattctcaacagaaaaggatgctgtcctatttgcactgaaaagcccggcgtttgcacggtgtttggagatccccactacaacacttttgacggtcggacatttaactttcaggggacgtgtcagtacgttttgacaaaagactgctcctcccctgcctcgcccttccaggtgctggtgaagaacgacgcccgccggacacgctccttctcgtggaccaagtcggtggagctggtgctgggcgagagcagggtcagcctgcagcagcacctcaccgtgcgctggaacggctcgcgcatcgcgctcccctgccgcgcgccacacttccacatcgacctggatggctacctcttgaaagtgaccaccaaagcaggtttggaaatatcttgggatggagacagttttgtagaagtcatggctgcgccgcatctcaagggcaagctctgtggtctttgtggcaactacaatggacataaacgtgatgacttaattggtggagatggaaacttcaagtttgatgtggatgactttgctgaatcttggagggtggagtccaatgagttctgcaacagacctcagagaaagccagtgcctgaactgtgtcaagggacagtcaaggtaaagctccgggcccatcgagaatgccaaaagctcaaatcctgggagtttcagacctgccactcgactgtggactacgccactttctaccggtcctgtgtgacagacatgtgtgaatgtccagtccataaaaactgttattgcgagtcatttttggcatatacccgggcctgccagagagagggcatcaaagtccactgggagcctcagcagaattgtgcagccacccagtgtaagcatggtgctgtgtacgatacctgtggtccgggatgtatcaagacgtgtgacaactggaatgaaattggtccatgcaacaagccgtgcgttgctgggtgccactgtccagcaaacttggtccttcacaagggaaggtgcatcaagccagtcctttgtccccagcggtgacctttgtttcgatccttaagactctgaaatctggtgactttgacactgaagcggaagagccaatgaaggactgcagtatttgtgtgcccgattctgtaaacacacacacacagagtatatatgtgtatatatatatagatatattcaaaaacattgcatcatttatatgaactatagggggattattatatgtatattttttgctataagacatgtattgtttctaggatcctaacctgtaagccattgaacatgttgtataaatacaccaggtgtttttaatttaataaggtggcatgcagatacattggatagtgttaacatcacatacatttgtcatttttaaggaagttttctaagagccctcaattgcctgcctgtattaattttagttttgagtcaggatttgtaatggagtgggaaatgtgtttctctggagaagggcacatttatctaggggcatttcaggtttccaaagaaaggaatgtatgcctgggaaagacagcaggagattggtgaccggccctaatggtgcatgaaaagcgagtgataggctgttagaatgtattaggtcatgggctaacattatttccaaaattgattggctggttgccaagaaatatatatttgtcactagggcataaccgaagaatcaagtgatttcttgccatccttgcgtagtcctcaagtcttctaatcatctatgtgtgtatgatggatgtgaccatttatatgtcatgtgttgaaattaaagggtgtctggatgccatgttaattttattgagcatgagaaagtatttgaagaaactgttgcacaacatatgatgaaattttgatttctctgaatctcagagtaatttaagatgggcaaatccaatgagttgatgtaacccatctacattttgtggctatttcatgtataaaatgaaaggctttagttatttctagaggagtcccatccaacactatttggcgactgttaatatgttataattattagacagtggaaaagcctttattgactaattgatttaacctcagtccaaagaacagtctctatacttgccctcatttactgataggctgctactagttaccatttgattgtcttgactttcgtcttcagttgaattggtgaaaacatcaacaaaaacaaaacccactgtgtcttaaaataaaatgttctgcattgtagtcaataaagggcttaagatgtaaaacaatgcattttctctctcaagatgtcctgtgttatactttacaattagttgtatcaacttcagattcattaaattttaacagctgtatttagttataatttttgtatcttacaacagtatatataaagactattattaatagacaaaagcaaacccacgtttttgacaagccagcatattgccaatgctcgtcaaagacatttatgtttcttttacattcatgacagctaaagtattaacttggaatttttttttttttttttgactggaaaatccctagttgtttgaattaactgaataaagtgcagggcgtaatagtgactggctgggggcactgggcctttgtgttttttttcattcctgtgtttggatactaatcaccctcgtatctgcagcctgaggtagtcaggtcattgtttcaatgctgcccttggaaagaagactttgacttaggtgctttgggatctaagtgtggtttgtgactatccccattatttaagcatttgggggtctcacttttgcttatctgtaacacaaagaggccatgtagtatagtgagcagggttgagaatcgggaaaactagacccctgccactaacaggctaggagactttgggcagtaatgggaggcactgagggtttgcaaatactttcctacttgtaatctcattgattccctgctctgccctgacaggaggggtagggaaaatcagttgacgttgcctggtggttcctaccttctgtaaaacgaacagattccttaagattagctttaaatcccttttcagttcactgttggttctcatctttgaaagagggcagcataagggaaatgatggagaagggagaattgtggatggttatttatagctcatgattcatccaaggactgagttattctccccatgaggctaaccggcctctttcccaacacttaatcatggcagccaggatgggtgaatgatgaaagctcttctgcatgagccggtttcatcatcttgggtgggttgattacaagtttgtgtggcattcctttagctggggattagcttaatctctgtacatttttctcatttctaattgaagaagaaagggagggcagagaggacagaaaattacttgggtttactaattcaaagagccatctctgatgggagagggtgaggaaatcagctgaatggttggcctgcatattcttttttaggccacaggctacagctgagcaatggcttagtctaatgattgggcacaatgaggatttaccaagtgcttcaatgagagcagtcctgtttcattcacatgggatgttttcaattggttcttcaactaagctcttgcagagtgagatgacttgaaataaaaatgttctatgaatattg

SEQ ID NO: 111684 - DNA, 844 bp, Homo sapiens
  Payload ID: 1875
  Gene Symbol: BMPER
  Gene Name: BMP binding endothelial regulator
  ENST ID: ENST00000448280
  CDS Start-End: 375-647
ggacagtggagacgcgccttctcggctctggtccgcgccctggggccctggcctccctggaggggctggggaactggaagctgggccgagagagttcccgctgcagctatcgcgcagtccctcctgcgcccgggcgcccccagcgggttccgggaggcgcccggtgagcccacgtctgttgcggcggagcgagcgcgctccgggagggccgagagccggcggggctggcaggagctctcgggcgcccgcctccctccttcgcggacggtctcccgacacgccggctgagagcccttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgcatgagccaactagatggagcaatctgacacaaaacccagggttttatgactgacctagtgcgccagctgcatctggaggaaccagacgcaaacaacgcagagttgagggccaggtgaagcgggatccagctccccacttcaccccaaccccttcgactcctcaaaacctctgcaagaagctatttccttcggctggcaacttacagccagcaggtcccttcctcgtgcagaataaagccattctgggaaa

SEQ ID NO: 111685 - DNA, 565 bp, Homo sapiens
  Payload ID: 1875
  Gene Symbol: BMPER
  Gene Name: BMP binding endothelial regulator
  ENST ID: ENST00000436222
  CDS Start-End: 82-565
cttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttggttgcacctatgaaggaaatacctataacagctccttcaaatggcagagcccggctgagccttgtgttctacgccagtgccaggagggcgttgtcacagagtctggggtgcgctgtgttgttcattgtaaaaaccctttggagcatctgggaatgtgctgccccacatgtccaggctgtgtgtttgagggtgtgcagtatcaagaaggggaggaatttcagccagaaggaagcaaatgtaccaagtgttcctgcactggaggcag

SEQ ID NO: 111686 - DNA, 547 bp, Homo sapiens
  Payload ID: 1875
  Gene Symbol: BMPER
  Gene Name: BMP binding endothelial regulator
  ENST ID: ENST00000444773
  CDS Start-End: 76-477
gactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgaacaaggaagtgacatgtaagagagagaagtgccccgtgctgtcccgagactgtgccctggccatcaagcagaggggagcctgttgtgaacagtgcaaagtgcttgtctcaagggttttaagggacacagtcctgttcactcttaaatactggagactcccagtattttggttgcacctatgaaggaaatacctataacagctccttcaaatggcagagcccggctgagccttgtgttctacgccagtgccag

SEQ ID NO: 111687 - DNA, 3804 bp, Homo sapiens
  Payload ID: 1876
  Gene Symbol: BMP2K
  Gene Name: BMP2 inducible kinase
  Uniprot ID: Q9NSY1
  ENST ID: ENST00000335016
  CDS Start-End: 167-3652
cggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatg

SEQ ID NO: 111688 - DNA, 2741 bp, Homo sapiens
  Payload ID: 1876
  Gene Symbol: BMP2K
  Gene Name: BMP2 inducible kinase
  ENST ID: ENST00000389010
  CDS Start-End: 203-1270
agccgggcagctgcagcggagccgcggagcgggcggcggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataagtgttgtaaacaattactgagacacggagcactgttaactgaaattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaagtaagggacacttgaaggcttattttgcttcacagtaaaataacagctctattattattcagcaaggccaaagacttttgagaatgtgtatggaaaattctttttgtgcatttgagggcaaaattcaggccatcttcttatacatatactatcaaattatgttgtgtgcattagaaatcagttgcttgatagtagctattaaacccaatattgctgatagtatgctaatatcctaaaacttaaatattgcatatctatgaatgttaaattcagaatatctctaaaacatggaaaattgatgtttcaataaaaagggagacattttattattttgccttactaatgattttgcagctctgtttttctgcacactcaatagaaaatattgtgggtctgagatgccctttgaaaatgcctgaaagaaaacatgggctactacattatgttaatgttttgtaatgtccttttaatgagtggtgacataaaagggctgctttgttgtcctgatatggcaaaaattaaataaattctttttcactttaaa

SEQ ID NO: 111689 - DNA, 3195 bp, Homo sapiens
  Payload ID: 1876
  Gene Symbol: BMP2K
  Gene Name: BMP2 inducible kinase
  Uniprot ID: Q9NSY1
  ENST ID: ENST00000502871
  CDS Start-End: 167-2155
cggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaagtaagggacacttgaaggcttattttgcttcacagtaaaataacagctctattattattcagcaaggccaaagacttttgagaatgtgtatggaaaattctttttgtgcatttgagggcaaaattcaggccatcttcttatacatatactatcaaattatgttgtgtgcattagaaatcagttgcttgatagtagctattaaacccaatattgctgatagtatgctaatatcctaaaacttaaatattgcatatctatgaatgttaaattcagaatatctctaaaacatggaaaattgatgtttcaataaaaagggagacattttattattttgccttactaatgattttgcagctctgtttttctgcacactcaatagaaaatattgtgggtctgagatgccctttgaaaatgcctgaaagaaaacatgggctactacattatgttaatgttttgtaatgtccttttaatgagtggtgacataaaagggctgctttgttgtcctgatatggcaaaaattaaataaattctttttcactttaaatcagatatctcaatgtttttacttggaatcattgcttttctttgaactacctaatatatgtcaagcttcgccacacatattttagaaatgtcctttttgaaagaatgatgtgagtgttttgagtaggttgccaaataggagcaaaaagctcacttctagagtatgtagataattttcaggtttctgaggctttgtgtgtgtgtgtgtgtgtgcacgcgcatgtgtgtgcaggtgtgcacacaaaacaagtgtgttttccccttttgcatgtgaaaagaaggtcttaataatccctagtttatagttcctagttcctatttcatttaggtaattggccttatgagaatgtttaatagatgaaatgctttgttctgaattggtatatattttatgtaaaattcctgtaagaatagtttgggatttaaatttgtattttatatattggttatatgattatgaaaattaaattgatgattaaatgcagatataaaaataagttctgagccgttaataaaggtttctaaataaaaccga

SEQ ID NO: 111690 - DNA, 6902 bp, Homo sapiens
  Payload ID: 1876
  Gene Symbol: BMP2K
  Gene Name: BMP2 inducible kinase
  ENST ID: ENST00000502613
  CDS Start-End: 1-2563
atttcaagtgtcatattttgcatttaaatttgccaaaaaggattgtccagtctccaacatcaataattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatgaagtatctctacagggtagtaacttgattcctcttcaggagaaaagggagctaaattgcaagctctaactaagggtttctgctactgacatcacaacacagaaatgcaagtgtggtacttccagtgaaagcacatggcacctttctaggtgtgtagccactgagaagggacagtgaaactgttatttttgatatcagaatgtcatttttatgtgcatatccctaaaattagggttatttctacatacactagttacacttgtgaattttttttaaggtctcttttaatttccagacagttaaaaacaatctagttatcttaaagcattagaaagttattatctggagagtgcagagatttcagtccatacacctttctccacaaagcagagccagaagtaactgactattgtgcctaaaactctgtttcatttttaaaaacaagtgccattaaaatggaatatctaatgataagcatatgaaataatgtgtaattagctcaatttaactattccacaacttacatattccaaaacaatgttatacatgataaatatatataatttttgtcagttaaaacaaattaaaaaaatggactatcgtcgcacagaagcctagaacaaaaatatgaagagaaatatctgacatttgtaaagaaattataagaagaaaaaaagatacagaacagaaaacattcactactttagaaacactttatgcatggcttcttgccccaaacttttattgtgatggccctaataaagcagattattggaaaaattggaggacaagggttgtataaaaattttattttatgaagaaaatatgtagcggaaactgaattttcaagacatttacaatgtgaaatcatgttgcatttaacaatgtactttattagcaacttcaccaaatattccccaagtcataagcaacaattatttttattaggttttggggggtggagtagttttaataaagtgcacagaatggtgacacccacaaagccttatataaaggcaggattcatgcatcctgctgcaagtacctctgcactaatataccagatcctaaaatgcatataaggtggactagcatcttaattctgctagttgattgtgtctttactgaaaagaacccagctaccaatttgcctttttttacaccacaaatcctaattagaaacttgaggttttatagaaatcatttaatgatagagattacatatgtgaattaatgtgaatatagtatctgtgcttcctgtgtctatgactattttaagatataattgtgctgcgctatcagattaacatttggaagtttctagaacagttaatgctatttacagaaaggagtagaaactcatcaactggcactctctttgatttttatattttaaattaactctcttcgatctcaaagtatattttacgagtaattttattaggaatctcttatagtgccccaatgggataagctatttgcctattttcacagttctgaacttggaaagaagcaaagtatatgtaactaaaccacatatttgtctttttattgctttttcccttcttttatatgctaaatcaaatatagatttgtggatagggaagcaatatgtgaatcacaatgtagcagaggcagaccaagcattacattattatttagagctggactgcaccaattacttgtcctcgtgccaaaggcaaatatgtttgcacctttttttttttttctgattctcaggttgattaatactgctaatgcaaatgctcaagtagatgtttaaaaactttacaaaatagattcaagtgatactttcttttaaaagtgaagagttgatgattacacatagtaaattcatgaactacagtaggtttgtatcaaacaattttttttaatgaaaatctgttgaggtgtacacaatatgcttcttgattgtattagtccttggtctctgctagacctcatgagtttcatcatttagaaaaggggtagaggatgaactaatgtctccttcagatgtaaacatgaaatacctagagttttacttgcttttcaatacactgaataattttaaatgattctgacactgatgtagaccctttgacttataaattctgaggaaacaactgacagcataaaatatttacattcttataacacagcacagtgactttcttctttcaagattgtagctcagagaaaagatacaggattcaattgggggttcaataggatagaaatggagagattcctttgtgttgtagtagaggcattttcctaaggagtatagatttatactttgcattttcattcatcatcccccagaatcatggtcaaggtgtaggtcactccacacagctgatgctcaggttattcccttgtgagaattatgagaataaagctcccaagatatgtgaaagtgcttaacacagtacctggcacacagcactcaataaaagtttggctctattatgggatggttcaattctggtttaaggaaggaagaaaggttattatatatgtaccactaagcaaatatatatatatatatatatttggggttttttttccctaatattatttgggtgtcccctgtgcttctttaggatgtagttataactaaacctgttatacttgaacatcactaagagaagtaaattattatgaagctagcaaaaatcttgaggccaaagttgtttcttaacagctttaataatgcttgttgattttgaataatcctttaaaaagtggaccatttgcttattttaatatcacgtcagtaaaatgttagtattaaaaagatcagctttttatggcattgaagaatgtatctgctaagacacaaaaattgcatggtaagtataataggtggaggaggaaaggttgtaggccggatgaaaatttaactgactagaacatttattcaggagtgtaattattttcccttaccccaatccctgtgtacgtgttgggtatagttacgacattatccggatttgcaaatagacacaactttcagtcttaccctgtttattgtttaagagtgatagactgttgtcctcttgctggtggaaaatctaaggtggagcccactcttctatgctgaagttcaccaggcagagcagttttcttacaagtcagctactctgcttggtttattttaggttttggtacttcacgtaagcactgttagaaggtacaagtgtattaatatcactagttttgaggcgcttgggtacatttgtttttaatatatttagaatgtgcagtaaacttttttctcatttttttttctttttagcaaacttgttattttaggtccaattattgagttgacagtctactgtgagaatgagatgacatatctactgtgagaataccataaatgatgaatagtttatttgagaacttttatactcagtggtgttttatatattaagataaaaatatgtacacacatgcatgtcacatctctctactgtggagttaatgtgaatttttaaaaaatggaattgcaaccacaatcatatctaagagaacattcactcctagtgagggtttacaaaagctactaagagaataaggtagatgataatgcaaagggtcatgatttggggttatttttgttttattttaaaatttatactgctacttttgaaagaattgtttttatgactatgctctttttgtgattgaaaagtcatctaatagaagctgtatagaagctactttttaattgctggcaaacagctttaagtgcactttctttgattacacttccattttttgttaaacttgaattttctgaagccttttatgtaccactaagcaaataactttaacctttaaataaagcaaatttacatctttattgtatttctacttgttacaaaacatacttgctaaagtaacttcagtcctcaaatatagctgggaaacaattatgagatagactcagtctccccctcccaccccttttcccctgccatatctaattaagcactaactgattttattactttattgcctttacactgcttattctttttgactgaattctgtccctgattcactgttttgtttgaaatttaaagttattttcttactgtatttatcatacctgttttaatctgttttctttaaatgcaataaatcccaaatggattgcatattctttataatcagtga

SEQ ID NO: 111691 - DNA, 3848 bp, Homo sapiens
  Payload ID: 1876
  Gene Symbol: BMP2K
  Gene Name: BMP2 inducible kinase
  ENST ID: ENST00000628286
  CDS Start-End: 167-1234
cggggcccaggctgtgcgcttggggagcgcggaatgtgaggcttggcgggccgcagcacgctcggacgggccaggggcggcgacccctcgcggacgcccggctgcgcgccgggccggggacttgcccttgcacgctccctgcgccctccagctcgccggcgggaccatgaagaagttctctcggatgcccaagtcggagggcggcagcggcggcggagcggcgggtggcggggctggcggggccggggccggggccggctgcggctccggcggctcgtccgtgggggtccgggtgttcgcggtcggccgccaccaggtcaccctggaagagtcgctggccgaaggtggattctccacagttttcctcgtgcgtactcacggtggaatccgatgtgcattgaagcgaatgtatgtcaataacatgccagacctcaatgtttgtaaaagggaaattacaattatgaaagagctatctggtcacaaaaatattgtgggctatttggactgtgctgttaattcaattagtgataatgtatgggaagtccttatcttaatggaatattgtcgagctggacaggtagtgaatcaaatgaataagaagctacagacgggttttacagaaccagaagtgttacagatattctgtgatacctgtgaagctgttgcaaggttgcatcagtgtaagactccaataattcaccgggatctgaaggtagaaaatattttgttgaatgatggtgggaactatgtactttgtgactttggcagtgccactaataaatttcttaatcctcaaaaagatggagttaatgtagtagaagaagaaattaaaaagtatacaactctgtcatacagagcccctgaaatgatcaacctttatggagggaaacccatcaccaccaaggctgatatctgggcactgggatgtctactctataaactttgtttcttcactcttccttttggtgagagtcaggttgctatctgtgatggcaacttcaccatcccagacaattctcgttactcccgtaacatacattgcttaataaggttcatgcttgaaccagatccggaacatagacctgatatatttcaagtgtcatattttgcatttaaatttgccaaaaaggattgtccagtctccaacatcaataagtgttgtaaacaattactgagacacggagcactgttaactgaaattcttctattccttcagctcttcctgaaccgatgactgctagtgaagcagctgctaggaaaagccaaataaaagccagaataacagataccattggaccaacagaaacctcaattgcaccaagacaaagaccaaaggccaactctgctactactgccactcccagtgtgctgaccattcaaagttcagcaacacctgttaaagtccttgctcctggtgaattcggtaaccatagaccaaaaggggcactaagacctggaaatggccctgaaattttattgggtcagggacctcctcagcagccgccacagcagcatagagtactccagcaactacagcagggagattggagattacagcaactccatttacagcatcgtcatcctcaccagcagcagcagcagcagcagcagcaacagcaacagcagcagcagcaacagcaacagcagcagcagcagcagcagcagcagcaccaccaccaccaccaccaccacctacttcaagatgcttatatgcagcagtatcaacatgcaacacagcagcaacagatgcttcaacaacaatttttaatgcattcggtatatcaaccacaaccttctgcatcacagtatcctacaatgatgccgcagtatcagcaggctttctttcaacagcagatgctagctcaacatcagccgtctcaacaacaggcatcacctgaatatcttacctcccctcaagagttctcaccagccttagtttcctacacttcatcacttccagctcaggttggaaccataatggactcctcctatagtgccaataggtcagttgctgataaagaggccattgcaaatttcacaaatcagaagaacatcagcaatccacctgatatgtcagggtggaatccttttggagaggataatttctctaagttaacagaagaggaactattggacagagaatttgaccttctaagatcaaataggctcgaggagagagcatcctcagataagaatgtagactcactttctgctccacataaccatcctccagaagatccttttggttctgttcctttcatttctcattcaggttctcctgaaaagaaagctgaacattcatctataaatcaagaaaatggcactgcaaaccctatcaagaacggtaaaacaagtccagcatctaaagatcagcggactggaaagaaaacctcagtacagggtcaagtgcaaaaggggaatgatgaatctgaaagtgattttgaatcagatcccccttctcctaagagcagtgaagaggaagagcaagatgatgaagaagttcttcagggggaacaaggagattttaatgatgatgatactgaaccagaaaatctgggtcataggcctctcctcatggattctgaagatgaggaagaagaggagaaacatagctctgattctgattatgagcaggctaaagcaaagtacagtgacatgagctctgtctacagagacagatctggcagtggaccaacccaagatcttaatacaatactcctcacctcagcccaattatcctctgatgttgcagtggagactcccaaacaggagtttgatgtatttggcgctgtccccttctttgcagtgcgtgctcaacagccccagcaagaaaagaatgaaaagaacctccctcaacacaggtttcctgctgcaggactggagcaggaggaatttgatgtattcacaaaggcgccttttagcaagaaggtgaatgtacaagaatgccatgcagtggggcctgaggcacatactatccctggttatcccaaaagtgtagatgtatttggctccactccatttcagcccttcctcacatcaacaagtaaaagtgaaagcaatgaggacctttttgggcttgtgccctttgatgaaataacggggagccagcagcaaaaagtcaaacagcgcagcttacagaaactgtcctctcgccaaaggcgcacaaagcaggatatgtccaaaagtaatgggaagcggcatcatggcacgccaactagcacaaagaagactttgaagcctacctatcgcactccagagagggctcgcaggcacaaaaaagtgggccgccgagactctcaaagtagcaatgaatttttaaccatctcagactccaaggagaacattagtgttgcactgactgatgggaaagatagggggaatgtcttacaacctgaggagagcctgttggaccccttcggtgccaagcccttccattctccagacctgtcatggcaccctccacatcagggcctgagcgacatccgtgctgatcacaatactgtcctgccagggcggccaagacaaaattcactacatgggtcattccatagtgcagatgtattgaaaatggatgattttggtgccgtgccctttacagaacttgtggtgcaaagcatcactccacatcagtcccaacagtcccaaccagtcgaattagacccatttggtgctgctccatttccttctaaacagtagatacttctgatggattctcggcattaactcctgtttcaaaaaagtgtgaacagttttatgaatttgaaagaaaatttggtagctctttatagcattcattcttaaagatcagtcagaataggtgatttctaaataaaccaaatagaagaatg

SEQ ID NO: 111692 - DNA, 7753 bp, Homo sapiens
  Payload ID: 1877
  Gene Symbol: BMS1
  Gene Name: BMS1 ribosome biogenesis factor
  Uniprot ID: Q14692
  ENST ID: ENST00000374518
  CDS Start-End: 64-3912
gctgacctgaggagtcgcggctgcgagcaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaaaaagcgcagactcaccattattgaatgtgggtgtgacattaacatgatgattgatctggctaaagtagcagatctggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccgggtgccaagctgttctacctttctggaatggtgcatggagaatatcaaaaccaagaaatccacaatctgggccgttttattacagttatgaagtttaggcctctcacatggcaaacttctcacccttatatcctggcagacaggatggaagatttgacaaacccagaggatatccgaacaaacatcaaatgtgaccggaaggtgtcactttatggttatttaagaggagcacacttgaaaaataaaagccaaattcacatgccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggatgaagtggggcccacccatgagctggtccagagtctcatctctacccactccaccattgatgccaagatggcttcaagtcgagtgacgctgttttctgattccaagccacttgggtcagaggatatagataatcaagggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtgccctcaagtggaaggaagacctttccagaaaggcagctgaggcctttctgaggcagcagcaagcagctccaaacctccgaaagcttatttatgggacagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggttatgaacagtatcagagattgcttcgtgactggaaagtgggaagatgataaagatgcagccaaggtcttagcagaagatgaggagctctacggtgactttgaagacttggaaacaggggacgtgcacaagggaaaatcaggccccaatactcagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggccctatcactccacagggaactggtttcttggcaatacagtctgtcagtggcataatgcctgattttcggatagctgctacaggagttgtccttgatctggataaatccataaaaattgtgaagaaattaaagctaactggttttccatataaaattttcaagaacacttcatttattaagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcgatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacaagtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttacttttggcttagtagttttcattagggatgaatgcctgacaattctttgtggataattatttatactaccaccttcatgaggagtcttccagaagagaaagaaatattcacttgaactctgagctcccatggaagattttagagaatagtgtgtagtgtttttgttttgttttttgtttgagtgacacacaaacctagatggtacagcctactgtgcacccaggatctatgggctcctttgatcactggcccttgtggacattttctatcttatttcatatgttctgcacattagtatagtgacaaggtaacagtaagtacttttttaaagctttagacttaggagattattgtctcaggtgcagagaccaaggaaatcgtatgtatcagtgagataggcttcccgtattatgctcatgcgttatacctgcctagctacattgcctttttttaaattaaacattatgttgaagtaatcatactattacataggcgatgtatgtattttatgattgtatgttgatatagttatggggaatctattcctatacgatgtaatcatagattcacatatagttgtatattttgcccaatttctctcagtggtaatgtttcacacatataacaatcaggatgttgacatcaatacagcccgctgattttattcacatttccccagctttactttccccaacgtatactcctccatgtatgcatgggtgtgtagaaatatggaacgcagctgggcacagtgactcacgcctgtaatcccagcactttgggatgctaaggcaggaggatcacttgagcccaggaatttgagaccaacttgggcaacatggcaaaacctcatcgctacaaaaaataaaaaattcgccaggtgtggtgggtgcacacctgtagttccagctgcttgggaggctgaggtaggaggatcacttgagcttgggaggttgaggctgcagtgagccatgatagcaccactgcactccagcctgggcgacagggcaagaccctgtttcaaaaaaaaaaaattatacatatatgtatgtagaacacttcatgaatttgtgtgtcatctgtgcatggggcccatgctgacctctgtgttgtgccagttatagtatgtgtgctgctgatatgagtgccacattgcctttacaacatcataggggccaaagagggttggcaggattatgagcagttggcctagtctgagaggctctctaaaagcctaaagtctgtaggcaggtgctcagctttgtatctccataagaagggaagaggatgtgaggatcctgtcagggctaggtccacctgggaagtgacaattggaacactcccagacctctctgggcaactctgggtgtacattttcctctgttcctcaagagctattatgaatttcatcatccattatgctgataggcctggggactgacacatagtaagcccataacaattataatttaaaactaatttgttatatagcataattgatatattttaaaatgcaaaactataattcaactaaaatatacaaggcactcaagtcataccatgttttaagtagcttacaaggtgatcagcaagtgtcttatacaacaagcaaatttgttcaaagagaagcattgcaaataagtatttataattgtatagttttatattttagccagaagagtggaatcctttagcaatgggggaaataaaagaatgtttaattacagttgcagataattgccttttccaaagacaatgtatgtaggcagaactcatacctgttaatattaaaaatcttggtttatcatatttggagaacaagggaaataaaaagtttgcatattaagattatttaaactaaagttaaggaatctctaatgtctgaaagaaacaataaatagcatttttcatgtagaatttttattggtgaaggttccacctggccaggttagtaaaatacagtcacacatcagttaaggatggggatatattctgagaaatgtatcattaggcaattttgtcattgtgtaaacatcatagagtgacacacaaacctagatggtacagcctactgtgcacctgggctctatggtatggcctgttgctcctaggctacaaacctgggcagcatgtgactgtactgactactgtaggcagttgtaacacagtggtaaacatttgtgtatcgaaacatagaaaaggcgtagcaaaaatacagtattgtggaaccactgccatatacgtggtccatccttgactgaacatcatgcggcatgtggctgtatgtatacacatagtttttgctgtgagtttgcatccatctcataggaagacatatatcaaaataaggaccagactggagagtgtgtaaattacttttcaatactaatggcttattaatttgatattgtcagcaagtatgttgcaaaaacaaattccaccagaatgtgagttccatgagagcaggaactgggttgttcaccttgttggcacttggagtagagccactgagcttcgtgctgcataaaattgcttggaagaaagaagggagggcattccaggtaactgaagcattgctatgcaaagtaagcatttgccctctgaaatattttaacaatgtttatagaaacctttctcaattgtattaaactttgtaaattgtaaaaattattctgttataccttttctatttactaggcacaggcagccataggtgctaggtatgttttgaaaacatattgaacctacagtgtacatatcattccatgccattaaatattcttatttaatcatagatgtgttcaggtgtgtttggtttcctatttgtggatgtactagattgttttctttttttaacaaaacctgtgaacttgctttaagtattatcatttggtgacatgcccgccatttcagaaataaatgtttgagcaaagaggaaagccaccgggtctgattcagctctctggaggctccagagcttacctcgctgatgggaaaaagagcatcgatttaattgcccttggtaccgacttctagtatctagtattttgccagactcaggtatttcttaaagccattattcagagtcttcagcaaggacattgtattttacttgtgtctccttagttttacctagtttatttcatggttttaaagtattgtacatttttataatcctttaacaagacaaaaggttgagatgttggacatttaaatgccaaaggtgttttattatgagacttagcatttcatatttggggatggtaccttatcgaaaatcagataaactttggttggatgggtatttggaggaatcttttaagtcttttcttaagcaaagtttggacactctaaaataaggttgccaactggcatgtagagagaaaaggatgtgtcatacatttagaccaggtggcctgtcctgtaaatttttttgaggggaggggtgggcttgtttttttctgtgtttcggttttttccaatttttgttttgtgataaaatatgcataataaaacttattttatcaatttttaa

SEQ ID NO: 111693 - DNA, 2531 bp, Homo sapiens
  Payload ID: 1878
  Gene Symbol: BMX
  Gene Name: BMX non-receptor tyrosine kinase
  Uniprot ID: P51813
  ENST ID: ENST00000348343
  CDS Start-End: 122-2149
aggaaaatgtgaaacaatttgcttctggaaacaggacagccggggccgtgttcctgcaacagcagaccaagcaccgcggcggacccaggcaagcacggaacaagctgagacggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 111694 - DNA, 2499 bp, Homo sapiens
  Payload ID: 1878
  Gene Symbol: BMX
  Gene Name: BMX non-receptor tyrosine kinase
  Uniprot ID: P51813
  ENST ID: ENST00000342014
  CDS Start-End: 102-2129
gtgatggtgcctcaaagcagtaactttttgcttagagcttgagagtcaaagttaaggacccacatgtatacttcggctctagcgagtctaaggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagta

SEQ ID NO: 111695 - DNA, 2598 bp, Homo sapiens
  Payload ID: 1878
  Gene Symbol: BMX
  Gene Name: BMX non-receptor tyrosine kinase
  Uniprot ID: P51813
  ENST ID: ENST00000357607
  CDS Start-End: 189-2216
atgaacatacatcacaatgtgaacagtggtcatctccagatagtagaatttcagatatgtttctttccatttttctgacagtttgaattttctgtaataattaattgacttttatacaatggaaacaacttttttgttttggaaaaaagaaagatgctgccgctaatcagtggatgaaagatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 111696 - DNA, 1580 bp, Homo sapiens
  Payload ID: 1879
  Gene Symbol: ABO
  Gene Name: BO blood group (transferase A, alpha 1-3-N-acetylgalactosaminyltransferase
  transferase B, alpha 1-3-galactosyltransferase)
  ENST ID: ENST00000626615
  CDS Start-End: 26-1090
ggaggccgagaccagacgcggagccatggccgaggtgttgcggacgctggccggaaaaccaaaatgccacgcacttcgacctatgatccttttcctaataatgcttgtcttggtcttgtttggttacggggtcctaagccccagaagtctaatgccaggaagcctggaacgggggttctgcatggctgttagggaacctgaccatctgcagcgcgtctcgttgccaaggatggtctacccccagccaaaggtgctgacaccgtgtaggaaggatgtcctcgtggtgaccccttggctggctcccattgtctgggagggcacattcaacatcgacatcctcaacgagcagttcaggctccagaacaccaccattgggttaactgtgtttgccatcaagaaatacgtggctttcctgaagctgttcctggagacggcggagaagcacttcatggtgggccaccgtgtccactactatgtcttcaccgaccagctggccgcggtgccccgcgtgacgctggggaccggtcggcagctgtcagtgctggaggtgcgcgcctacaagcgctggcaggacgtgtccatgcgccgcatggagatgatcagtgacttctgcgagcggcgcttcctcagcgaggtggattacctggtgtgcgtggacgtggacatggagttccgcgaccacgtgggcgtggagatcctgactccgctgttcggcaccctgcaccccggcttctacggaagcagccgggaggccttcacctacgagcgccggccccagtcccaggcctacatccccaaggacgagggcgatttctactacctgggggggttcttcggggggtcggtgcaagaggtgcagcggctcaccagggcctgccaccaggccatgatggtcgaccaggccaacggcatcgaggccgtgtggcacgacgagagccacctgaacaagtacctgctgcgccacaaacccaccaaggtgctctcccccgagtacttgtgggaccagcagctgctgggctggcccgccgtcctgaggaagctgaggttcactgcggtgcccaagaaccaccaggcggtccggaacccgtgagcggctgccaggggctctgggagggctgccggcagccccgtccccctcccgcccttggttttagcagaacgggtaaactctgtttcctttgtccgtcctgttgtgagtaactgaagcctaggccccgtccccacctcaaatcacacacaccccctccccaccacagagacaccattacatacacagacacacacagaaagacacacacagacacaaaatcacacacacaccctccccgccacagagacaccattacatacacagacacacacagaaagacacagacacaaaatcacacacacaccctccccgccacagagacacaccattacatacacagacacgcaatcgcagatacgcccttccggccacagaaacacaccattacacacacatacacagaaagacacacacagacacacaatcacacgcagcccctccccgccacagagacacaccattacatacacagacacacacagaaagacac

SEQ ID NO: 111697 - DNA, 3517 bp, Homo sapiens
  Payload ID: 1880
  Gene Symbol: BBX
  Gene Name: bobby sox homolog (Drosophila)
  Uniprot ID: Q8WY36
  ENST ID: ENST00000325805
  CDS Start-End: 288-3113
atgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggtcctttccagtctcagaaaaagaacttattccacaaaattgtcagcaaatataagcacaaaaaggagaagcccaatgttccggaaaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaac

SEQ ID NO: 111698 - DNA, 3980 bp, Homo sapiens
  Payload ID: 1880
  Gene Symbol: BBX
  Gene Name: bobby sox homolog (Drosophila)
  ENST ID: ENST00000402543
  CDS Start-End: 420-3095
ggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggcaccctcaggaagaccccaagcctctagcagtacctggtatcatctccagcatgttatagatgtggaggattcactgggatattgagaaataccagaggcgaattgttccactgtagtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaac

SEQ ID NO: 111699 - DNA, 1586 bp, Homo sapiens
  Payload ID: 1880
  Gene Symbol: BBX
  Gene Name: bobby sox homolog (Drosophila)
  ENST ID: ENST00000402163
  CDS Start-End: 242-1586
agttcgagcaggcacgggcacggggacaccccactcgttgctcctccgttatggaaaggtgtttagcagacttttacgcccggagtgtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaa

SEQ ID NO: 111700 - DNA, 3674 bp, Homo sapiens
  Payload ID: 1880
  Gene Symbol: BBX
  Gene Name: bobby sox homolog (Drosophila)
  Uniprot ID: Q8WY36
  ENST ID: ENST00000406780
  CDS Start-End: 538-3273
tgctcagatcagcttcctgcttctcatgaaagctgttcccctataaagctggtctgctttcactgaaagaattatattcataagtctgaggctggttttgtggaagtattgttggtttggtttcctttgggggatgaaggaggaggaaacaattttttttaaaaaaaaagtgggggcaggctgaaagagcaaaatcatcttgaattttgttgtcacatcgtgccggtgttataaccagctctgtagactgccgcactgaaaacatttctgtgagagaatcctgctgcatcacagaagctggaagttctgatgttccactgaaatcacaatggaaagtcttgacttgactggtaagagctgttgtgaaggtacatcttacttacttacctggaagcagtgaggcagtcaagaattatgtgctgtcagagctggtctcagcatgatcaaggaagtgtgatcattggatatttttttcttgtcaattttattattttttaaagtgtgacttttattgatctccattatcaagtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaa

SEQ ID NO: 111701 - DNA, 601 bp, Homo sapiens
  Payload ID: 1880
  Gene Symbol: BBX
  Gene Name: bobby sox homolog (Drosophila)
  ENST ID: ENST00000431630
  CDS Start-End: 244-601
aataagtttaaggtggagagagcgaggctgagggtggtggtggaggggaggaggaaggccttggccgtttaaagtcttatttctgaaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataagaccagaatagaagctcagtataagaacaggggccttgcctgtctcgtcctttcctcttgcctcagaaatgagaatggtgcctggcacatagttcaacttcttggggccgatggcctagagcaagatgttggtgaaactgaagatgatgaatcaccagagcagcgagcccggagaccaatgaatgcatttcttttat

SEQ ID NO: 111702 - DNA, 392 bp, Homo sapiens
  Payload ID: 1880
  Gene Symbol: BBX
  Gene Name: bobby sox homolog (Drosophila)
  ENST ID: ENST00000454540
  CDS Start-End: 354-392
gggctggggagtagtaggccagccggtgccaggctgcgtttgcaaccagcacctctcggcacacaggcagcgccgcctgagaggggcacgggcgccggggcgcgggctggagcggccccaggaaaacaacaacagagccctcacgccggcgggcggctcgtggccgcccggggagccccaaacttcatctcggcgaaagtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaa

SEQ ID NO: 111703 - DNA, 581 bp, Homo sapiens
  Payload ID: 1880
  Gene Symbol: BBX
  Gene Name: bobby sox homolog (Drosophila)
  ENST ID: ENST00000456817
  CDS Start-End: 367-581
agactcgaggtttcttttcctcctccacctcgtctcgctcactcaccctctgaaatttattatcatattttatttattttttggtattgtatgaaacttaacataactgagaccgaacccgagtcctgtaatttacaaggaccctgaatcccagaatctggaacacgtttatgtgtgaaatagccgcgatcatttctgctaaatgaggaaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaaga

SEQ ID NO: 111704 - DNA, 410 bp, Homo sapiens
  Payload ID: 1880
  Gene Symbol: BBX
  Gene Name: bobby sox homolog (Drosophila)
  ENST ID: ENST00000458347
  CDS Start-End: 1-396
aacactccagagccaacaacaacgcaagaacctttggtgggcagccaaaagagaaaagcaaggaaaaccaagattacacaccttgtcaggacagcagatggccgggtatcaccagcaggagatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcatt

SEQ ID NO: 111705 - DNA, 238 bp, Homo sapiens
  Payload ID: 1880
  Gene Symbol: BBX
  Gene Name: bobby sox homolog (Drosophila)
  ENST ID: ENST00000443253
  CDS Start-End: 1-238
gactaaaaccagcaaaggtcctttccagtctcagaaaaagaacttattccacaaaattgtcagcaaatataagcacaaaaaggagaagcccaatgttccggaaaaaggaagtggggataaatggtcaaacaagcaactcttcttggatgccattcaccctacagaagagccaacaacaacgcaagaacctttggtgggcagccaaaagagaaaagcaaggaaaaccaagattacacac

SEQ ID NO: 111706 - DNA, 819 bp, Homo sapiens
  Payload ID: 1880
  Gene Symbol: BBX
  Gene Name: bobby sox homolog (Drosophila)
  ENST ID: ENST00000413213
  CDS Start-End: 373-819
aatcctgctgcatcacagaagctggaagttctgatgttccactgaaatcacaatggaaagtcttgacttgactggtaagagctgttgtgaaggtacatcttacttacttacctggaagcagtgaggcagtcaagaattatgtgctgtcagagctggtctcagcatgatcaaggaagtgtgatcattggatatttttttcttgtcaattttattattttttaaagtgtgacttttattgatctccattatcaagcatatgggccactgaaaacttctgagcaatggatataaatgagatggaacagaaggaaaaaaaggtagacattggaaagactggtttagggggctttactattatcctaggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatgg

SEQ ID NO: 111707 - DNA, 2178 bp, Homo sapiens
  Payload ID: 1880
  Gene Symbol: BBX
  Gene Name: bobby sox homolog (Drosophila)
  Uniprot ID: Q8WY36
  ENST ID: ENST00000416476
  CDS Start-End: 221-2107
agaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggtcctttccagtctcagaaaaagaacttattccacaaaattgtcagcaaatataagcacaaaaaggagaagcccaatgttccggaaaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttga

SEQ ID NO: 111708 - DNA, 513 bp, Homo sapiens
  Payload ID: 1880
  Gene Symbol: BBX
  Gene Name: bobby sox homolog (Drosophila)
  ENST ID: ENST00000458458
  CDS Start-End: 221-513
agactcgaggtttcttttcctcctccacctcgtctcgctcactcaccctctgaaatttattatcatattttatttattttttggtattgtatgaaacttaacataactgagaccgaacccgagtcctgtaatttacaaggaccctgaatcccagaatctggaacacgtttatgtgtgaaatagccgcgatcatttctgctaaatgaggaaggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgt

SEQ ID NO: 111709 - DNA, 556 bp, Homo sapiens
  Payload ID: 1880
  Gene Symbol: BBX
  Gene Name: bobby sox homolog (Drosophila)
  ENST ID: ENST00000457496
  CDS Start-End: 302-556
atgcattctgaataacataaactgaaatagtaagctgaaatataacaagtctgggtttttttttttttttttttgcattagaaatttatttttgctgttgtatttttagacggtcctagctagtagatgcatgcttttcacgtttggatatcagagttggatatggtttgaatcccagctgtactagcttttaaacgttgggcaatctacttcacaatgctgaatctcaatttccacatgtgtaaactaacaccggaaatatttacctcaaagagtcctgagtacgtgctaggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaat

SEQ ID NO: 111710 - DNA, 552 bp, Homo sapiens
  Payload ID: 1880
  Gene Symbol: BBX
  Gene Name: bobby sox homolog (Drosophila)
  ENST ID: ENST00000449271
  CDS Start-End: 212-552
acatcttacttacttacctggaagcagtgaggcagtcaagaattatgtgctgtcagagctggtctcagcatgatcaaggaagtgtgatcattggatatttttttcttgtcaattttattattttttaaagtgtgacttttattgatctccattatcaaatgctctttgacttaaaatggggctacatcctgatacactcactgtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatact

SEQ ID NO: 111711 - DNA, 843 bp, Homo sapiens
  Payload ID: 1880
  Gene Symbol: BBX
  Gene Name: bobby sox homolog (Drosophila)
  ENST ID: ENST00000449213
  CDS Start-End: 367-843
cttacttacttacctggaagcagtgaggcagtcaagaattatgtgctgtcagagctggtctcagcatgatcaaggaagtgtgatcattggatatttttttcttgtcaattttattattttttaaagtgtgacttttattgatctccattatcaaatggggaaactgaagaacagagaggtgaaattatctgcccaaggttacgctgctaataagtggcaaagctggaattcaaactcaggctgtctggctgcagggtttgttctcctaaccacaccaccacactgcctgtagattatcctcacatgtttgggtatccttttacattcatgtgcatgaatgcactgtttatttttaacgtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatcc

SEQ ID NO: 111712 - DNA, 675 bp, Homo sapiens
  Payload ID: 1880
  Gene Symbol: BBX
  Gene Name: bobby sox homolog (Drosophila)
  ENST ID: ENST00000449335
  CDS Start-End: 244-675
aataagtttaaggtggagagagcgaggctgagggtggtggtggaggggaggaggaaggccttggccgtttaaagtcttatttctgaaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaat

SEQ ID NO: 111713 - DNA, 8930 bp, Homo sapiens
  Payload ID: 1880
  Gene Symbol: BBX
  Gene Name: bobby sox homolog (Drosophila)
  Uniprot ID: Q8WY36
  ENST ID: ENST00000415149
  CDS Start-End: 328-3063
aaaatgagtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttggctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggaagtggggataaatggtcaaacaagcaactcttcttggatgccattcaccctacagaagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttggatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggaccttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaaactgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatcttttttttaaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaaatattttaaagatattattcaaatatatttctttatgttcacactactggccgtagagtatgtgcctttaatgtaccattttcactaaaaacagtaggaaaaatactaataaaagtaagatatttcaacta

SEQ ID NO: 111714 - DNA, 550 bp, Homo sapiens
  Payload ID: 1880
  Gene Symbol: BBX
  Gene Name: bobby sox homolog (Drosophila)
  ENST ID: ENST00000425868
  CDS Start-End: 479-550
tcttacttacttacctggaagcagtgaggcagtcaagaattatgtgctgtcagagctggtctcagcatgatcaaggaagtgtgatcattggatatttttttcttgtcaattttattattttttaaagtgtgacttttattgatctccattatcaagcatatgggccactgaaaacttctgagcaatggatataaatgagatggaacagaaggaaaaaaaggtagacattggaaagactggtttagggggctttactattatcctagatggggaaactgaagaacagagaggtgaaattatctgcccaaggttacgctgctaataagtggcaaagctggaattcaaactcaggctgtctggctgcagggtttgttctcctaaccacaccaccacactgcctgtagattatcctcacatgtttgggtatccttttacattcatgtgcatgaatgcactgtttatttttaacgtcacagtaatgaaaggcagtaatagaaataaggatcattcagcagaaggagaaggggttggaaaacgaccaaaacgaaag

SEQ ID NO: 111715 - DNA, 871 bp, Homo sapiens
  Payload ID: 1880
  Gene Symbol: BBX
  Gene Name: bobby sox homolog (Drosophila)
  ENST ID: ENST00000456419
  CDS Start-End: 256-871
agaccgccgccagttcgagcaggcacgggcacggggacaccccactcgttgctcctccgttatggaaaggtgtttagcagacttttacgcccggagtgtggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgg

SEQ ID NO: 111716 - DNA, 959 bp, Homo sapiens
  Payload ID: 1880
  Gene Symbol: BBX
  Gene Name: bobby sox homolog (Drosophila)
  ENST ID: ENST00000427402
  CDS Start-End: 379-959
ggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctgggaatatccttggaattaatatacctggaacaattctttctgcagttaaagattggtgcctggccagaaatgcctgtgaaacagctgtggtttaagcttcaactgtaaaagacagacggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctca

SEQ ID NO: 111717 - DNA, 539 bp, Homo sapiens
  Payload ID: 1880
  Gene Symbol: BBX
  Gene Name: bobby sox homolog (Drosophila)
  ENST ID: ENST00000429270
  CDS Start-End: 42-539
tttgctaagaggtagtgttagggcaaggcctggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatcca

SEQ ID NO: 111718 - DNA, 4276 bp, Homo sapiens
  Payload ID: 1881
  Gene Symbol: BOC
  Gene Name: BOC cell adhesion associated, oncogene regulated
  Uniprot ID: Q9BWV1
  ENST ID: ENST00000273395
  CDS Start-End: 340-3687
gtttctcatagttggcgtcttctaaaggaaaaacactaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaagcaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaa

SEQ ID NO: 111719 - DNA, 4278 bp, Homo sapiens
  Payload ID: 1881
  Gene Symbol: BOC
  Gene Name: BOC cell adhesion associated, oncogene regulated
  Uniprot ID: Q9BWV1
  ENST ID: ENST00000355385
  CDS Start-End: 340-3684
gtttctcatagttggcgtcttctaaaggaaaaacactaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttc

SEQ ID NO: 111720 - DNA, 1286 bp, Homo sapiens
  Payload ID: 1881
  Gene Symbol: BOC
  Gene Name: BOC cell adhesion associated, oncogene regulated
  ENST ID: ENST00000484034
  CDS Start-End: 152-625
ttagagatagtttttctcatcctcaagtattgggagtccaactttgagtggaatctggactaaacttcagagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccagtgagtctgctcctttgcctccctgccatggtgcggtccctcctcatctctcccaccctgaagcccccaccattcatgctgcctcttgttactcttagcataaaatgggccttaactgcagaaatgtcaaatcagaacagtagctgcctagtaatgcccagtgatgggggacccttgtgcccttggaaaacctcactccaagtagaggctgtatctggagtgagtgtctacagagaggggaattggtcagtgcatggcagaacttgacatggcagaactgttccgtgggccccagagcagggccgtgccgtgccttcctacttggtcatcctgtggctgtaggtgcactgtcccaactgctcacacaccttccagtcccctccctccattctcaccacagttacagtcggagcagggagagacaggacaccaagagacatgggcagggccacgtgtagtctggacagagcccacccagcccagacttggcctcctgtctctctgtgaggggcaagcatagtccgaaggcctggattataaatattagaacataatgaaaaggaaactgtgtggcaaagggataaagggatacagagaaaagaaacaaggaagagatgaggtgacagtttggaccaaggaaaatgccaagagaagacttcacactaccttttttttttctggttttgccattcttttattcatgttgttacactcagtataggatagtttattaaaatcattatgtctgtagacattcta

SEQ ID NO: 111721 - DNA, 582 bp, Homo sapiens
  Payload ID: 1881
  Gene Symbol: BOC
  Gene Name: BOC cell adhesion associated, oncogene regulated
  ENST ID: ENST00000464546
  CDS Start-End: 329-582
aaccgaccgagggggtcgggggaggctgcgttaaggcttccctgagattggtttccttatcattttctccaccgccgctgtcccattttctgatgagtttgcttttaatgatttatccaacagtttgtcttgcagaagaagaagaccattgagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcct

SEQ ID NO: 111722 - DNA, 561 bp, Homo sapiens
  Payload ID: 1881
  Gene Symbol: BOC
  Gene Name: BOC cell adhesion associated, oncogene regulated
  ENST ID: ENST00000462425
  CDS Start-End: 497-561
gagctgcggccgaggctgggcgcgccgggcgccgggcgaagaagttggggcgaggcgggcagcgggggtcccgggggctgcagccgctacggggcccaggggcgccgcatctcgttccctgccgcagcggtctggccgggcgatggtggtttcgcctcagcggttcccagaagcttctcgggtggaagaaggatccagccagcctcccaaacttccaccgaaggttgacaccagcgccccggccccatgctccaggccgtggggggaacccgaggcgtggcggcaaatgcgtagagtcactcaacacgcactcggcctctttggaggtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcct

SEQ ID NO: 111723 - DNA, 317 bp, Homo sapiens
  Payload ID: 1881
  Gene Symbol: BOC
  Gene Name: BOC cell adhesion associated, oncogene regulated
  ENST ID: ENST00000473008
  CDS Start-End: 1-119
ttcagcagcagagtgacaccagcagcctgctgaggcagacccatcttggcaatggatatgacccccaaagtcaccagatcacgagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgtttttttttt

SEQ ID NO: 111724 - DNA, 544 bp, Homo sapiens
  Payload ID: 1881
  Gene Symbol: BOC
  Gene Name: BOC cell adhesion associated, oncogene regulated
  ENST ID: ENST00000494687
  CDS Start-End: 448-544
actaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaagtagaagaagtgggtgaggttttctcttcagtctgatagctctggcctattaggtcagccatttgttcatgttttgtgttaccacttagagatagtttttctcatcctcaagtattgggagtccaactttgagtggaatctggactaaacttcagagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttga

SEQ ID NO: 111725 - DNA, 4646 bp, Homo sapiens
  Payload ID: 1881
  Gene Symbol: BOC
  Gene Name: BOC cell adhesion associated, oncogene regulated
  Uniprot ID: Q9BWV1
  ENST ID: ENST00000495514
  CDS Start-End: 705-4049
cctcctcctcctcctcgcacggtaatgggaggctcctaggcaggagaagcaaaagaaggaattgtttgcgagttcagtcatccaaaaagcttcttccatatggagggaccgggtgcgctgggcgcggcgtcccctgcgttgtcctcctgctgccgcccccgcggccgccgctttctgccgcggggaccctgagccccggcccgccggtgtcagccgccgcgcgcgcgcacagacacacacacagagacacacaaacacacacagaaaagacacacacgcgcacacacggcgcgcacaccctcacgcccgccacagccacaacacgcccgcacgcgccctccctctccggcccgcaacttctcggtcctcggctcctttgttgctccagccgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaaagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttcaaa

SEQ ID NO: 111726 - DNA, 703 bp, Homo sapiens
  Payload ID: 1881
  Gene Symbol: BOC
  Gene Name: BOC cell adhesion associated, oncogene regulated
  ENST ID: ENST00000498710
  CDS Start-End: 509-703
aagaaggaattgtttgcgagttcagtcatccaaaaagcttcttccatatggagggaccgggtgcgctgggcgcggcgtcccctgcgttgtcctcctgctgccgcccccgcggccgccgctttctgccgcggggaccctgagccccggcccgccggtgtcagccgccgcgcgcgcgcacagacacacacacagagacacacaaacacacacagaaaagacacacacgcgcacacacggcgcgcacaccctcacgcccgccacagccacaacacgcccgcacgcgccctccctctccggcccgcaacttctcggtcctcggctcctttgttgctccagccgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaagtggatctccaggacttcaagttagatgtgcagcacgtgattgaagtggatgagggaaacacagcagtcattgcctgccacctgcctgagagccaccccaaagcccaggtccggtacagcgtcaaacaagag

SEQ ID NO: 111727 - DNA, 564 bp, Homo sapiens
  Payload ID: 1881
  Gene Symbol: BOC
  Gene Name: BOC cell adhesion associated, oncogene regulated
  ENST ID: ENST00000488486
  CDS Start-End: 1-253
acgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaag

SEQ ID NO: 111728 - DNA, 2173 bp, Homo sapiens
  Payload ID: 1881
  Gene Symbol: BOC
  Gene Name: BOC cell adhesion associated, oncogene regulated
  ENST ID: ENST00000485230
  CDS Start-End: 626-1099
aaaaagcttcttccatatggagggaccgggtgcgctgggcgcggcgtcccctgcgttgtcctcctgctgccgcccccgcggccgccgctttctgccgcggggaccctgagccccggcccgccggtgtcagccgccgcgcgcgcgcacagacacacacacagagacacacaaacacacacagaaaagacacacacgcgcacacacggcgcgcacaccctcacgcccgccacagccacaacacgcccgcacgcgccctccctctccggcccgcaacttctcggtcctcggctcctttgttgctccagccgcggccgctcgcccgtgttgtgtgtccccggtgtcaccgagcgtgttgtgtgtccgtgcggcgcggcgctgtgtggctccctcgcgcccaccacgctggcccccgggccccggctcgcccttcccaggcgccggctgcagcagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccagtgagtctgctcctttgcctccctgccatggtgcggtccctcctcatctctcccaccctgaagcccccaccattcatgctgcctcttgttactcttagcataaaatgggccttaactgcagaaatgtcaaatcagaacagtagctgcctagtaatgcccagtgatgggggacccttgtgcccttggaaaacctcactccaagtagaggctgtatctggagtgagtgtctacagagaggggaattggtcagtgcatggcagaacttgacatggcagaactgttccgtgggccccagagcagggccgtgccgtgccttcctacttggtcatcctgtggctgtaggtgcactgtcccaactgctcacacaccttccagtcccctccctccattctcaccacagttacagtcggagcagggagagacaggacaccaagagacatgggcagggccacgtgtagtctggacagagcccacccagcccagacttggcctcctgtctctctgtgaggggcaagcatagtccgaaggcctggattataaatattagaacataatgaaaaggaaactgtgtggcaaagggataaagggatacagagaaaagaaacaaggaagagatgaggtgacagtttggaccaaggaaaatgccaagagaagacttcacactaccttttttttttctggttttgccattcttttattcatgttgttacactcagtataggatagtttattaaaatcattatgtctgtagacattctatttgtgatatagaaattgtgttatttctgacctctattttttcctattatgtgacaaagaacataggtcctcagaccaacatgtggaaaccaagggccaaatggcttctaaggtccctcccaactgaataattctggtaaattccatttccatgtgctcactgacggatggtcctaataaccgctcttatttcttttatgcttgtgaaagtcatagtttttacaaaattacttgagggtgtattataaagattcaacagagcaaagtaaaggccaagtgacttgacatagtcatagctggaagaggagccttaccaagacaggtgtttctagttgccattatacttattctaccttatgaggacccattgtatgaggctagatggaagtgagtaaacagacgtcctacctttg

SEQ ID NO: 111729 - DNA, 811 bp, Homo sapiens
  Payload ID: 1882
  Gene Symbol: BOLA1
  Gene Name: bolA family member 1
  Uniprot ID: Q9Y3E2
  ENST ID: ENST00000369150
  CDS Start-End: 323-736
agtcctggccctgagcgggaatcgcagtggccgaggctgagcggcaggtagaaggggcgtctccggggcttcacagggaacacaggggcttcggcccaaccacaactggaggtcgaattcaccacgtcacgtagagaaaaggggcggtgtctcgggtctccccgtgtggcatcaaggcgggctccctataggagctggtgtggacgtccgggcgtggggttagggcggatgcggggatcgcggggcgggtgttgacattgtgctctcaccaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacag

SEQ ID NO: 111730 - DNA, 859 bp, Homo sapiens
  Payload ID: 1882
  Gene Symbol: BOLA1
  Gene Name: bolA family member 1
  Uniprot ID: Q9Y3E2
  ENST ID: ENST00000369152
  CDS Start-End: 127-540
aggactgcattttgctccggagcgtccagagtcctggccctgagcgggaatcgcagtggccgaggctgagcggcaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacacta

SEQ ID NO: 111731 - DNA, 1096 bp, Homo sapiens
  Payload ID: 1882
  Gene Symbol: BOLA1
  Gene Name: bolA family member 1
  Uniprot ID: Q9Y3E2
  ENST ID: ENST00000369153
  CDS Start-End: 665-1078
gcctccctgctttccgcgtcctgacattacggctaaaattgcagttacagcttcttttacaaggagaagaatgtggaaagaataaccaatttgatgtaatttataagagctaccgggaggggtgaagggaagtcgtttgattggctaaaagcggagccgtatctaacagccaatagaaaagcagaaagccgcctcttggtttgcgtcctgcactgaaaggaaatgacggattttactttctgaccaccttaccagtggggagaatccgagactacagttcccatgagccctcagggcaccacgtggtgcctgcccgtgctaccaacgcgcagcgaggactccatttcccagcgtgcctcaggaagggcgccaggactgcattttgctccggagcgtccagagtcctggccctgagcgggaatcgcagtggccgaggctgagcggcagctggaggtcgaattcaccacgtcacgtagagaaaaggggcggtgtctcgggtctccccgtgtggcatcaaggcgggctccctataggagctggtgtggacgtccgggcgtggggttagggcggatgcggggatcgcggggcgggtgttgacattgtgctctcaccaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggagga

SEQ ID NO: 111732 - DNA, 1012 bp, Homo sapiens
  Payload ID: 1883
  Gene Symbol: BOLA2
  Gene Name: bolA family member 2
  Uniprot ID: Q9H3K6
  ENST ID: ENST00000330978
  CDS Start-End: 514-972
cttcctcccggcacagaaggcctccccctctcaccagggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccaggggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctgga

SEQ ID NO: 111733 - DNA, 1442 bp, Homo sapiens
  Payload ID: 1883
  Gene Symbol: BOLA2
  Gene Name: bolA family member 2
  ENST ID: ENST00000380596
  CDS Start-End: 112-570
gtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatttaacgtttcttctttttccttgacaaatcttgataagtttttttatattagttttattttctagaaaacgtcttatgaatttctcccatttgctctagcatgcttatagaaaatgtcagtgtttcttacagctcaaatttgtatagttgttttaaaatgcggtctctttcttcttcccctggtacttttttctttc

SEQ ID NO: 111734 - DNA, 1012 bp, Homo sapiens; identical to SEQ ID NO: 111732
  Payload ID: 1884
  Gene Symbol: BOLA2B
  Gene Name: bolA family member 2B
  Uniprot ID: Q9H3K6
  ENST ID: ENST00000305321
  CDS Start-End: 514-972

SEQ ID NO: 111735 - DNA, 335 bp, Homo sapiens
  Payload ID: 1884
  Gene Symbol: BOLA2B
  Gene Name: bolA family member 2B
  ENST ID: ENST00000569282
  CDS Start-End: 1-245
aaggtagcgtggccggcgcccgagctggggttgtgtccctgctgggctgccgttccagctggactgccgccatggaactcagcgccgaatacctccgcgagaagctgcagcgggacctggaggcggagcatgtgcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggac

SEQ ID NO: 111736 - DNA, 687 bp, Homo sapiens
  Payload ID: 1884
  Gene Symbol: BOLA2B
  Gene Name: bolA family member 2B
  ENST ID: ENST00000567436
  CDS Start-End: 1-267
tttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggtaaggccctgggagcaccttgcctagctcctgtaccacaaccccagccactccccctacccctgcaacctgactcccgcactccccctggcgtggctcagggaccttgaggatcccgccttcgtgacccctgcttcgagtatttcgatgtagaccctctctccaagtacgtgttcccacggcctggggactacaaccttggggacaccagtctcttgggtcaccctagcctcggggtgtgcgatcaccgctggccttttcctaaccccatctctcgccccaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggac

SEQ ID NO: 111737 - DNA, 444 bp, Homo sapiens
  Payload ID: 1885
  Gene Symbol: BOLA3
  Gene Name: bolA family member 3
  Uniprot ID: Q53S33
  ENST ID: ENST00000295326
  CDS Start-End: 32-337
gacctcgggcggcgggtcacgtcggccgggcatggctgcatggagcccggccgcggcagcgcctctcctccgcgggatccgcgggcttccacttcaccatcggatgtttgccactcagactgagggggagctcagagtgacccaaattctcaaagaaaagtttccacgagctacagctataaaagtcactgacatttcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaa

SEQ ID NO: 111738 - DNA, 639 bp, Homo sapiens
  Payload ID: 1885
  Gene Symbol: BOLA3
  Gene Name: bolA family member 3
  Uniprot ID: Q53S33
  ENST ID: ENST00000327428
  CDS Start-End: 121-444
ggaggctgacggcctccgggcggcagggggcggcctctcccacggcggcggctctcggtcccccgctccgcgtctttcgggcatacagtgacctcgggcggcgggtcacgtcggccgggcatggctgcatggagcccggccgcggcagcgcctctcctccgcgggatccgcgggcttccacttcaccatcggatgtttgccactcagactgagggggagctcagagtgacccaaattctcaaagaaaagtttccacgagctacagctataaaagtcactgacatttcaggaggttgtggggcgatgtatgaaattaaaattgaatcagaagaatttaaggagaagagaactgtccagcagcaccagatggttaatcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaagcttttgaagggtcatt

SEQ ID NO: 111739 - DNA, 2833 bp, Homo sapiens
  Payload ID: 1886
  Gene Symbol: BRS3
  Gene Name: bombesin-like receptor 3
  Uniprot ID: P32247
  ENST ID: ENST00000370648
  CDS Start-End: 229-1428
ctccacctcctactcttcagtgccagatgggtaagcatttagccaagcatgctgggagacacacagaactgaagcaaaggagtatctggatgtcttggattttcttcccattctgttctgttctgttctcctaataccatctcgttactagacgtaggcattggacgtgacaatcaactgcatttgaactgagaagaagaaatattaaagacacagtcttcagaagaaatggctcaaaggcagcctcactcacctaatcagactttaatttcaatcacaaatgacacagaatcatcaagctctgtggtttctaacgataacacaaataaaggatggagcggggacaactctccaggaatagaagcattgtgtgccatctatattacttatgctgtgatcatttcagtgggcatccttggaaatgctattctcatcaaagtctttttcaagaccaaatccatgcaaacagttccaaatattttcatcaccagcctggcttttggagatcttttacttctgctaacttgtgtgccagtggatgcaactcactaccttgcagaaggatggctgttcggaagaattggttgtaaggtgctctctttcatccggctcacttctgttggtgtgtcagtgttcacattaacaattctcagcgctgacagatacaaggcagttgtgaagccacttgagcgacagccctccaatgccatcctgaagacttgtgtaaaagctggctgcgtctggatcgtgtctatgatatttgctctacctgaggctatattttcaaatgtatacacttttcgagatcccaataaaaatatgacatttgaatcatgtacctcttatcctgtctctaagaagctcttgcaagaaatacattctctgctgtgcttcttagtgttctacattattccactctctattatctctgtctactattccttgattgctaggaccctttacaaaagcaccctgaacatacctactgaggaacaaagccatgcccgtaagcagattgaatcccgaaagagaattgccagaacggtattggtgttggtggctctgtttgccctctgctggttgccaaatcacctcctgtacctctaccattcattcacttctcaaacctatgtagacccctctgccatgcatttcattttcaccattttctctcgggttttggctttcagcaattcttgcgtaaacccctttgctctctactggctgagcaaaagcttccagaagcattttaaagctcagttgttctgttgcaaggcggagcggcctgagcctcctgttgctgacacctctcttaccaccctggctgtgatgggaacggtcccgggcactgggagcatacagatgtctgaaattagtgtgacctcgttcactgggtgtagtgtgaagcaggcagaggacagattctagcttttcaaggaaaaatgctgcttctcctcccagcgtgtgtatccgactctaagctgtgtgcaggtgtatggtgtccagatttttgttgtttgaaaagtgtgttgaaatcttaggagtgaaggatccctataagtaagtaaaatacaaaccattactttcttcaaagtacaaatagtaatgtcatcgggctttctaaataaaatgaagccccactaagtgcagaaagacaagtttatatatgccagtgaatcgtaagggaagtcaaatgggaaggaaggtgtaataaacaagatgaaacttaaaaatctcatttgttgtttaatcacatctgtgatgcttctaactcctcatatactgtgatttgcataaaattgtgtttgtgtttactgtgtggtgtaaatctagagatactttgtatgtgaaaaggggatcacaaaagagagaaagcatctcttaggctattttcttaaaaataaaccttcacagaatggctgtccttttccattaatctgtattccattgtagctgaatctgtgcagttgaaatgaaaatgttttggagtcagcgaatataaagcactgagtaaggatctggggcacagtgcttgccttactgggtcaacacttacaactgccatggattaataactgggctaagttatcattcacaaatattgttaggaacttgccttattcataggcagaataagtggtcatgtttatggtgtcatttgaggacctctgttgaaaaatctgcaaacctgccacagtgtctgaaattcttcctttacagaaattcgtttctttctggtaagcagtgccctctttctaaaaacatgcagaagtaccatatgaaatccctaacccctgggtgtgcaattgtgatcagatcatcttcctgcttgactttattaaacccaatgggtgcctaagtcctgtaagtgtatggcctaattaatctctgcccatggaaatcagatggaaagttctgattttctatcctgtgctcctacctgctaacatcattcacttgttaataattattgttttaaaaaaaaaaactcttgtcaatagacgtgtcagatttagacctgtggtttcagaaaaatttttggagcaaatttaaacatgtttggcactataggtaaatttgtatttaaaaaaaaaaacaatgtttgagtgtgcttttggtaatgctgagctttctttaaatggcttgtggagtcgtgaacttttgctaatgatgtggctccaaaaggtaatacatattaacattagactttaactttctgtaaaattggtttacttaaagttgggcggggggtgtgatactgtattagtattgttttaaagtggacactgtaacacgtgtggaaaaacaaataaatatgaaataaagttttaaa

SEQ ID NO: 111740 - DNA, 732 bp, Homo sapiens
  Payload ID: 1887
  Gene Symbol: BGLAP
  Gene Name: bone gamma-carboxyglutamate (gla) protein
  Uniprot ID: P02818
  ENST ID: ENST00000368272
  CDS Start-End: 271-573
gattgtggctcaccctccatcactcccaggggcccctggcccagcagccgcagctcccaaccacaatatcctttggggtttggcctacggagctggggcggatgacccccaaatagccctggcagattccccctagacccgcccgcaccatggtcaggcatgcccctcctcatcgctgggcacagcccagagggtataaacagtgctggaggctggcggggcaggccagctgagtcctgagcagcagcccagcgcagccaccgagacaccatgagagccctcacactcctcgccctattggccctggccgcactttgcatcgctggccaggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaatctg

SEQ ID NO: 111741 - DNA, 1480 bp, Homo sapiens
  Payload ID: 1888
  Gene Symbol: BST1
  Gene Name: bone marrow stromal cell antigen 1
  Uniprot ID: Q10588
  ENST ID: ENST00000265016
  CDS Start-End: 196-1152
aaagtgctgggattacaggcatgagccgccgcgccccgccccacgctcagtcttgaaattgtctggaacgggaaacggcaaacagcgagatatccgagcgagagtcccgccctgcatcagtttgcggaaccgccttggtagaaggagagaaggggagtggaggaagcacgggactggagggaccaaagttccccgatggcggcccaggggtgcgcggcatcgcggctgctccagctgctgctgcagcttctgcttctactgttgctgctggcggcgggcggggcgcgcgcgcggtggcgcggggagggcaccagcgcacacttgcgggacatcttcctgggccgctgcgccgagtaccgcgcactgctgagtcccgagcagcggaacaagaactgcacagccatctgggaagcctttaaagtggcgctggacaaggatccctgctccgtgctgccctcagactatgacctttttattaacttgtccaggcactctattcccagagataagtccctgttctgggaaaatagccacctccttgttaacagctttgcagacaacacccgtcgttttatgcccctgagcgatgttctgtatggcagggttgcagatttcttgagctggtgtcgacagaaaaatgactctggactcgattaccaatcctgccctacatcagaagactgtgaaaataatcctgtggattccttttggaaaagggcatccatccagtattccaaggatagttctggggtgatccacgtcatgctgaatggttcagagccaacaggagcctatcccatcaaaggtttttttgcagattatgaaattccaaacctccagaaggaaaaaattacacgaatcgagatctgggttatgcatgaaattgggggacccaatgtggaatcctgcggggaaggcagcatgaaagtcctggaaaagaggctgaaggacatggggttccagtacagctgtattaatgattaccgaccagtgaagctcttacagtgcgtggaccacagcacccatcctgactgtgccttaaagtcggcagcagccgctactcaaagaaaagccccaagtctttatacagaacaaagggcgggtcttatcattcccctctttctggtgctggcttccaggactcaactgtaactggaaactgtgttgctctaaccctcctccagccctgcagcctccccttgcagtcatcattcgtgttctgtgtataccaaatgattctgttatctaaagaagctttttgctgggaaaacgatgtcctgaaaatggtatttcaatgaggcatatgttcaggatttcagaaacaagaagttagttctatttagcaggttaaaaaatgctgcattagaattaaagcaagttattttcttatttgtataatgacacaaagcattgggagtcagactgcttgtatattatcaaacattttaagagaattctaataaagctgtattttacatca

SEQ ID NO: 111742 - DNA, 1993 bp, Homo sapiens
  Payload ID: 1888
  Gene Symbol: BST1
  Gene Name: bone marrow stromal cell antigen 1
  ENST ID: ENST00000382346
  CDS Start-End: 50-1051
gagaaggggagtggaggaagcacgggactggagggaccaaagttccccgatggcggcccaggggtgcgcggcatcgcggctgctccagctgctgctgcagcttctgcttctactgttgctgctggcggcgggcggggcgcgcgcgcggtggcgcggggagggcaccagcgcacacttgcgggacatcttcctgggccgctgcgccgagtaccgcgcactgctgagtcccgagcagcggcaaataagaaacagcagagaaccacctgtgttacacaccacccagaacaagaactgcacagccatctgggaagcctttaaagtggcgctggacaaggatccctgctccgtgctgccctcagactatgacctttttattaacttgtccaggcactctattcccagagataagtccctgttctgggaaaatagccacctccttgttaacagctttgcagacaacacccgtcgttttatgcccctgagcgatgttctgtatggcagggttgcagatttcttgagctggtgtcgacagaaaaatgactctggactcgattaccaatcctgccctacatcagaagactgtgaaaataatcctgtggattccttttggaaaagggcatccatccagtattccaaggatagttctggggtgatccacgtcatgctgaatggttcagagccaacaggagcctatcccatcaaaggtttttttgcagattatgaaattccaaacctccagaaggaaaaaattacacgaatcgagatctgggttatgcatgaaattgggggacccaatgtggaatcctgcggggaaggcagcatgaaagtcctggaaaagaggctgaaggacatggggttccagtacagctgtattaatgattaccgaccagtgaagctcttacagtgcgtggaccacagcacccatcctgactgtgccttaaagtcggcagcagccgctactcaaagaaaagccccaagtctttatacagaacaaagggcgggtcttatcattcccctctttctggtgctggcttccaggactcaactgtaactggaaactgtgttgctctaaccctcctccagccctgcagcctccccttgcagtcatcattcgtgttctgtgtataccaaatgattctgttatctaaagaagctttttgctgggaaaacgatgtcctgaaaatggtatttcaatgaggcatatgttcaggatttcagaaacaagaagttagttctatttagcaggttaaaaaatgctgcattagaattaaagcaagttattttcttatttgtataatgacacaaagcattgggagtcagactgcttgtatattatcaaacattttaagagaattctaataaagctgtattttacatcatctatattttcctatatctccagcagcacggacactgcatgcttgttgattgcttaagacatatgtatactatataaatgtatgcatatatggtctgcaaagttttcatttttcatttatttggtataaagatgttcagttaatggttcctttttgttttgagagacagagtttcgctcctttgcccaggctggagtgaggtggggagatctcagctcactgcaacctctgcttccaggattcaagcgattctcctgcctcagcctcccaagtagctgggattgcaggtgcctgccaccatgtccagctaatttttgtatttttagtagagatggggtttcaccatgttggccaggctagtctcgaattcctgacctcaggtgatccacccacctcagcctcccaaagtgctaggattacaggcgtgagccaccacatccagccataatagttacttataatgagggaaaaacccaaaatatccagtaatatttacatatttactgaaactgtttggaacttgtattagtttgttcttgcattgctataaagaactgcccgagactgggtaatttacaaaaataaaaataaaaaagaggtttaattgactcaca

SEQ ID NO: 111743 - DNA, 1002 bp, Homo sapiens
  Payload ID: 1888
  Gene Symbol: BST1
  Gene Name: bone marrow stromal cell antigen 1
  ENST ID: ENST00000514445
  CDS Start-End: 1-468
ggactcgattaccaatcctgccctacatcagaagactgtgaaaataatcctgtggattccttttggaaaagggcatccatccagtattccaaggatagttctggggtgatccacgtcatgctgaatggttcagagccaacaggagcctatcccatcaaaggtttttttgcagattatgaaattccaaacctccagaaggaaaaaattacacgaatcgagatctgggttatgcatgaaattgggggacccaatgtggaatcctgcggggaaggcagcatgaaagtcctggaaaagaggctgaaggacatggggttccagtacagctgtattaatgattaccgaccagtgaagctcttacagtgcgtggaccacagcacccatcctgactgtgccttaaagtcacccaagaggctatgtgggacattaggagtgcgacccagagcagaaccatacaaccgccggttctagcctttgtacaaggaaactgtgggaaccatgatggggaagatactgactgtcagagagtccaaagatgtaaatgccttccactcccacagcaaggaagccgaaatctccagaggctctggcaagagttgagtcaattgcatgcctgcctagtccagctccgtccacatgaatgctctccacaagcttcagaggaaacaggataaaatggactcccaaatatttagggtggtgaaaatactctgcatgatactagaattgtggatacaggtgattatatatgtgtccaaacctacagaaggtacaacaccaagggtgaaccctcaggtaaactacagaggctgggtgaccatgatgtttcaatgtcggttcattagttgtgacaaatgcaccactccaccactctggtggggatgctgccagtgggggaggctatgtatgtgtggggacagagcgtatgtgggaagctctgtactttctgctcaaatttgctgtgaacctaaaactgctctaaacattaaagcctattcaaaaaaa

SEQ ID NO: 111744 - DNA, 770 bp, Homo sapiens
  Payload ID: 1888
  Gene Symbol: BST1
  Gene Name: bone marrow stromal cell antigen 1
  ENST ID: ENST00000505785
  CDS Start-End: 1-560
agtccctgttctgggaaaatagccacctccttgttaacagctttgcagacaacacccgtcgttttatgcccctgagcgatgttctgtatggcagggttgcagatttcttgagctggtgtcgacagaaaaatgactctggactcgattaccaatcctgccctacatcagaagactgtgaaaataatcctgtggattccttttggaaaagggcatccatccagtattccaaggatagttctggggtgatccacgtcatgctgaatggttcagagccaacaggagcctatcccatcaaaggtttttttgcagattatgaaattccaaacctccagaaggaaaaaattacacgaatcgagatctgggttatgcatgaaattgggggacccaatgtggaatcctgcggggaaggcagcatgaaagtcctggaaaagaggctgaaggacatggggttccagtacagctgtattaatgattaccgaccagtgaagctcttacagtgcgtggaccacagcacccatcctgactgtgccttaaagtcagacggggtttcaccgtgttagccaggatggtctcgatctcctggccttgtgatccgccttccttggcctcctaaagtgctgggattacaggcgtaagccaccacgcctggcccacaccaccttttatgtaatcctttctgagtcatgggctggcttggttgtatgttgttatagtagttgttttgctattataaacaatgctgaaatataatccttgattatatactttaa

SEQ ID NO: 111745 - DNA, 801 bp, Homo sapiens
  Payload ID: 1888
  Gene Symbol: BST1
  Gene Name: bone marrow stromal cell antigen 1
  ENST ID: ENST00000514989
  CDS Start-End: 1-293
gttcagagccaacaggagcctatcccatcaaaggtttttttgcagattatgaaattccaaacctccagaaggaaaaaattacacgaatcgagatctgggttatgcatgaaattgggggacccaatgtggaatcctgcggggaaggcagcatgaaagtcctggaaaagaggctgaaggacatggggttccagtacagctgtattaatgattaccgaccagtgaagctcttacagtgcgtggaccacagcacccatcctgactgtgccttaaagtcgaaactgtgggaaccatgatggggaagatactgactgtcagagagtccaaagatgtaaatgccttccactcccacagcaaggaagccgaaatctccagaggctctggcaagagttgagtcaattgcatgcctgcctagtccagctccgtccacatgaatgctctccacaagcttcagaggaaacaggataaaatggactcccaaatatttagggtggtgaaaatactctgcatgatactagaattgtggatacaggtgattatatatgtgtccaaacctacagaaggtacaacaccaagggtgaaccctcaggtaaactacagaggctgggtgaccatgatgtttcaatgtcggttcattagttgtgacaaatgcaccactccaccactctggtggggatgctgccagtgggggaggctatgtatgtgtggggacagagcgtatgtgggaagctctgtactttctgctcaaatttgctgtgaacctaaaactgctctaaacattaaagcctattcaaaaaaatgaaa

SEQ ID NO: 111746 - DNA, 1019 bp, Homo sapiens
  Payload ID: 1889
  Gene Symbol: BST2
  Gene Name: bone marrow stromal cell antigen 2
  Uniprot ID: Q10589
  ENST ID: ENST00000252593
  CDS Start-End: 74-616
ataaaggggtggcccgtagaagattccagcaccctcccctaactccaggccagactctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggaagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacctga

SEQ ID NO: 111747 - DNA, 4229 bp, Homo sapiens
  Payload ID: 1890
  Gene Symbol: BMP1
  Gene Name: bone morphogenetic protein 1
  Uniprot ID: P13497
  ENST ID: ENST00000306385
  CDS Start-End: 671-3631
cgagagagcgagggtccaagaaggggagatagggagacgcgggcggagagaccgacccgaggcgggggcgcggggcaggggcggcgcgaggacctgacagcgtgtcccgcggcggggcgggggctcggccgcgcgcccgcgggggaggccgccgctagagggcacttcaggagggacagccctcccggcaccccggggcccgagctccagccccggcctcgcggcccgcggcccgcggcccgggcggcccgagccccctccccgggcgcgcggctctccgccttccccgccccggctggcgcgcggcccggcccggccgagcactgtcccggccccgaggggggcagagctcgggcgaaaacccgccctccagcgagctcatttccctaaaaaggggggggggagtcggagggagggagggagggagagaaagaaagagagaaaaagaaggaaagggagagggagacggctggagcccgaggacgagcgcggagccgcggaccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaa

SEQ ID NO: 111748 - DNA, 2626 bp, Homo sapiens
  Payload ID: 1890
  Gene Symbol: BMP1
  Gene Name: bone morphogenetic protein 1
  Uniprot ID: P13497
  ENST ID: ENST00000306349
  CDS Start-End: 155-2347
gagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgca

SEQ ID NO: 111749 - DNA, 3989 bp, Homo sapiens
  Payload ID: 1890
  Gene Symbol: BMP1
  Gene Name: bone morphogenetic protein 1
  ENST ID: ENST00000354870
  CDS Start-End: 267-1175
gtcggagggagggagggagggagagaaagaaagagagaaaaagaaggaaagggagagggagacggctggagcccgaggacgagcgcggagccgcggaccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccaggcgttctccactcttcactgctccttctcagctgtggctctagaaatggtgcttccttcccatgttcccttgagtcctccattcaccaggccctctgctggacaggactcttcctgagaccctccccattccccaggctccccttggctgctccccggaccctcagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagcc

SEQ ID NO: 111750 - DNA, 836 bp, Homo sapiens
  Payload ID: 1890
  Gene Symbol: BMP1
  Gene Name: bone morphogenetic protein 1
  ENST ID: ENST00000397814
  CDS Start-End: 267-836
gtcggagggagggagggagggagagaaagaaagagagaaaaagaaggaaagggagagggagacggctggagcccgaggacgagcgcggagccgcggaccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcggctcgggaccgcccccctga

SEQ ID NO: 111751 - DNA, 2663 bp, Homo sapiens
  Payload ID: 1890
  Gene Symbol: BMP1
  Gene Name: bone morphogenetic protein 1
  ENST ID: ENST00000518913
  CDS Start-End: 155-724
gagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcggctcgggaccgcccccctgagctggccccgccctccaggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgca

SEQ ID NO: 111752 - DNA, 2362 bp, Homo sapiens
  Payload ID: 1890
  Gene Symbol: BMP1
  Gene Name: bone morphogenetic protein 1
  ENST ID: ENST00000483364
  CDS Start-End: 7-915
gccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccaggcgttctccactcttcactgctccttctcagctgtggctctagaaatggtgcttccttcccatgttcccttgagtcctccattcaccaggccctctgctggacaggactcttcctgagaccctccccattccccaggctccccttggctgctccccggaccctcagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccag

SEQ ID NO: 111753 - DNA, 4333 bp, Homo sapiens
  Payload ID: 1890
  Gene Symbol: BMP1
  Gene Name: bone morphogenetic protein 1
  Uniprot ID: P13497
  ENST ID: ENST00000520970
  CDS Start-End: 220-2412
aaagggagagggagacggctggagcccgaggacgagcgcggagccgcggaccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagcc

SEQ ID NO: 111754 - DNA, 2695 bp, Homo sapiens
  Payload ID: 1890
  Gene Symbol: BMP1
  Gene Name: bone morphogenetic protein 1
  Uniprot ID: P13497
  ENST ID: ENST00000471755
  CDS Start-End: 7-1875
gccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggggtgttatgatctacaggttgggaaacccctgttgtgggacagacactgtttccgcctctccacgcatggtcccgagatgctggggacagcactccgaggctaatggctccagctcactaggccgatcctgctgtgcccccgagctgctccctttcctgcacctcccaggaccgcccctccctgaactgctttccctgagccccttattcccgctcactccctcttggaggaccttggcctgttcatttgcagagaagatagaaatggccacacttatgaccccttagctcccccactcctccctacaggcccacccctgaggacacccaggccaccctgcctcctcccgtccgccccagagggaccagacacaggtccctgagccttggggagtccacaggctccccatcttctccttactgcatcccagcccacatctcagcccttccccatggcaggggctccccgcagacgatgccaccttccttgtccccgcagctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccag

SEQ ID NO: 111755 - DNA, 3244 bp, Homo sapiens
  Payload ID: 1890
  Gene Symbol: BMP1
  Gene Name: bone morphogenetic protein 1
  ENST ID: ENST00000520982
  CDS Start-End: 83-652
cgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcggctcgggaccgcccccctgagctggccccgccctccaggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactgga

SEQ ID NO: 111756 - DNA, 3925 bp, Homo sapiens
  Payload ID: 1890
  Gene Symbol: BMP1
  Gene Name: bone morphogenetic protein 1
  ENST ID: ENST00000520626
  CDS Start-End: 83-268
cgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaagctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcggctcgggaccgcccccctgagctggccccgccctccaggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactgga

SEQ ID NO: 111757 - DNA, 2320 bp, Homo sapiens
  Payload ID: 1890
  Gene Symbol: BMP1
  Gene Name: bone morphogenetic protein 1
  Uniprot ID: P13497
  ENST ID: ENST00000521385
  CDS Start-End: 7-2160
gccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcaggaggggagctatttggacttttgggacacccaccgaggagaccctaagccaagaaggagaagaaagagcctgaagaccttcagtctgacccctgccaccttccggggcatttgggcactgtaggaaaagaggccagctctgcagccccctcggggacgcccccaccagctcaaattccgagtgcagaaaagaaaccggaccccccag

SEQ ID NO: 111758 - DNA, 1059 bp, Homo sapiens
  Payload ID: 1890
  Gene Symbol: BMP1
  Gene Name: bone morphogenetic protein 1
  ENST ID: ENST00000518656
  CDS Start-End: 72-641
aagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcggctcgggaccgcccccctgagctggccccgccctccaggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccaggcgttctccactcttcactgctccttctcagctgtggctctagaaatggtgcttccttcccatgttcccttgagtcctccattcaccaggccctctgctggacaggactcttcctgagaccctccccattccccaggctccccttggctgctccccggaccctcagggcaggagtataacttcctgaagatggagcctcaggaggtggagtccctggggga

SEQ ID NO: 111759 - DNA, 1584 bp, Homo sapiens
  Payload ID: 1891
  Gene Symbol: BMP10
  Gene Name: bone morphogenetic protein 10
  Uniprot ID: O95393
  ENST ID: ENST00000295379
  CDS Start-End: 160-1434
ggggagaggaagagtggtagggggagggagagagagaggaagagtttccaaacttgtctccagtgacaggagacatttacgttccacaagataaaactgccacttagagcccagggaagctaaaccttcctggcttggcctaggagctcgagcggagtcatgggctctctggtcctgacactgtgcgctcttttctgcctggcagcttacttggtttctggcagccccatcatgaacctagagcagtctcctctggaagaagatatgtccctctttggtgatgttttctcagagcaagacggtgtcgactttaacacactgctccagagcatgaaggatgagtttcttaagacactaaacctctctgacatccccacgcaggattcagccaaggtggacccaccagagtacatgttggaactctacaacaaatttgcaacagatcggacctccatgccctctgccaacatcattaggagtttcaagaatgaagatctgttttcccagccggtcagttttaatgggctccgaaaataccccctcctcttcaatgtgtccattcctcaccatgaagaggtcatcatggctgaacttaggctatacacactggtgcaaagggatcgtatgatatacgatggagtagaccggaaaattaccatttttgaagtgctggagagcaaaggggataatgagggagaaagaaacatgctggtcttggtgtctggggagatatatggaaccaacagtgagtgggagacttttgatgtcacagatgccatcagacgttggcaaaagtcaggctcatccacccaccagctggaggtccacattgagagcaaacacgatgaagctgaggatgccagcagtggacggctagaaatagataccagtgcccagaataagcataaccctttgctcatcgtgttttctgatgaccaaagcagtgacaaggagaggaaggaggaactgaatgaaatgatttcccatgagcaacttccagagctggacaacttgggcctggatagcttttccagtggacctggggaagaggctttgttgcagatgagatcaaacatcatctatgactccactgcccgaatcagaaggaacgccaaaggaaactactgtaagaggaccccgctctacatcgacttcaaggagattgggtgggactcctggatcatcgctccgcctggatacgaagcctatgaatgccgtggtgtttgtaactaccccctggcagagcatctcacacccacaaagcatgcaattatccaggccttggtccacctcaagaattcccagaaagcttccaaagcctgctgtgtgcccacaaagctagagcccatctccatcctctatttagacaaaggcgtcgtcacctacaagtttaaatacgaaggcatggccgtctccgaatgtggctgtagatagaagaagagtcctatggcttatttaataactgtaaatgtgtatatttggtgttcctatttaatgagattatttaataagggtgtacagtaatagaggcttgctgccttcaggaaatggacaggtcagtttgttgtaggaaatgcatatttt

SEQ ID NO: 111760 - DNA, 1179 bp, Homo sapiens
  Payload ID: 1892
  Gene Symbol: BMP15
  Gene Name: bone morphogenetic protein 15
  Uniprot ID: O95972
  ENST ID: ENST00000252677
  CDS Start-End: 1-1179
atggtcctcctcagtattcttagaattctttttctttgtgaactcgtgcttttcatggaacacagggcccaaatggcagaaggagggcagtcctctattgcccttctggctgaggcccctactttgcccctgattgaggagctgctagaagaatcccctggcgaacagccaaggaagccccggctcctagggcattcactgcggtacatgctggagttgtaccggcgttcagctgactcgcatgggcaccctagagagaaccgcaccattggggccaccatggtgaggctggtgaagcccttgaccaatgtggcaaggcctcacagaggtacctggcatatacagatcctgggctttcctctcagaccaaaccgaggactataccaactagttagagccactgtggtttaccgccatcatctccaactaactcgcttcaatctctcctgccatgtggagccctgggtgcagaaaaacccaaccaaccacttcccttcctcagaaggagattcctcaaaaccttccctgatgtctaacgcttggaaagagatggatatcacacaacttgttcagcaaaggttctggaataacaagggacacaggatcctacgactccgttttatgtgtcagcagcaaaaagatagtggtggtcttgagctctggcatggcacttcatccttggacattgccttcttgttactctatttcaatgatactcataaaagcattcggaaggctaaatttcttcccaggggcatggaggagttcatggaaagggaatctcttctccggagaacccgacaagcagatggtatctcagctgaggttactgcctcttcctcaaaacatagcgggcctgaaaataaccagtgttccctccaccctttccaaatcagcttccgccagctgggttgggatcactggatcattgctccccctttctacaccccaaactactgtaaaggaacttgtctccgagtactacgcgatggtctcaattcccccaatcacgccattattcagaaccttatcaatcagttggtggaccagagtgtcccccggccctcctgtgtcccgtataagtatgttccaattagtgtccttatgattgaggcaaatgggagtattttgtacaaggagtatgagggtatgattgctgagtcttgtacatgcagatga

SEQ ID NO: 111761 - DNA, 3601 bp, Homo sapiens
  Payload ID: 1893
  Gene Symbol: BMP2
  Gene Name: bone morphogenetic protein 2
  Uniprot ID: P12643
  ENST ID: ENST00000378827
  CDS Start-End: 1220-2410
gccgcgagcgccgcgccacggcgccgccgccgccgtcgccgccgccggagtcctcgccccgccgcgctgcgcccggctcgcgctgcgctagtcgctccgcttcccacaccccgccggggactggcagccgccgccgcacatctgccgccacagcctccgccggctacccgaacgttctcggggccagcgccgagtggatcaccggggaccgcgaggcacccgcgcgccgcagaccccgcgcgggctggagcacccggcagagcgcgccacagcgccgtggcctctgctgcccgggctgcgccagagccgcggacgggcgcgcagagcgccggggactccggagccgatccctagcgccgcgatgcggagcacctactgcaggagatcgggggcctgggacgcgctggccgaggtgtgatcggaccccaggctagccacaaagggcacttggccccagggctaggagagcgaggggagagcacagccacccgcctcggcggcccgggactcggctcgactcgccggagaatgcgcccgaggacgacggggcgccagagccgcggtgctttcaactggcgagcgcgaatgggggtgcactggagtaaggcagagtgatgcgggggggcaactcgcctggcaccgagatcgccgccgtgcccttccctggacccggcgtcgcccaggatggctgccccgagccatgggccgcggcggagctagcgcggagcgcccgaccctcgacccccgagtcccggagccggccccgcgcggggccacgcgtccctcgggcgctggttcctaaggaggacgacagcaccagcttctcctttctcccttcccttccctgccccgcactcctccccctgctcgctgttgttgtgtgtcagcacttggctggggacttcttgaacttgcagggagaataacttgcgcaccccactttgcgccggtgcctttgccccagcggagcctgcttcgccatctccgagccccaccgcccctccactcctcggccttgcccgacactgagacgctgttcccagcgtgaaaagagagactgcgcggccggcacccgggagaaggaggaggcaaagaaaaggaacggacattcggtccttgcgccaggtcctttgaccagagtttttccatgtggacgctctttcaatggacgtgtccccgcgtgcttcttagacggactgcggtctcctaaaggtcgaccatggtggccgggacccgctgtcttctagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagtacagcaaaattaaatacataaatatatatatatatatatattttagaaaaaagaaaaaaacaaacaaacaaaaaaaccccaccccagttgacactttaatatttcccaatgaagactttatttatggaatggaatggaaaaaaaaacagctattttgaaaatatatttatatctacgaaaagaagttgggaaaacaaatattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtgattgtccaatccatgagaatttacatccttattaggtggaatatttggataagaaccagacattgctgatctattatagaaactctcctcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattgatattgtggtcatatatatttaaaattgatatctcgtggccctcatcaagggttggaaatttatttgtgttttacctttacctcatctgagagctctttattctccaaagaacccagttttctaactttttgcccaacacgcagcaaaattatgcacatcgtgttttctgcccaccctctgttctctgacctatcagcttgcttttctttccaaggttgtgtgtttgaacacatttctccaaatgttaaacctatttcagataataaatatcaaatctctggcatttcattctataaagtccaacctgtaagagaaaa

SEQ ID NO: 111762 - DNA, 5734 bp, Homo sapiens
  Payload ID: 1894
  Gene Symbol: BMP3
  Gene Name: bone morphogenetic protein 3
  Uniprot ID: P12645
  ENST ID: ENST00000282701
  CDS Start-End: 321-1739
agatcttgaaaacacccgggccacacacgccgcgacctacagctctttctcagcgttggagtggagacggcgcccgcagcgccctgcgcgggtgaggtccgcgcagctgctggggaagagcccacctgtcaggctgcgctgggtcagcgcagcaagtggggctggccgctatctcgctgcacccggccgcgtcccgggctccgtgcgccctcgccccagctggtttggagttcaaccctcggctccgccgccggctccttgcgccttcggagtgtcccgcagcgacgccgggagccgacgcgccgcgcgggtacctagccatggctggggcgagcaggctgctctttctgtggctgggctgcttctgcgtgagcctggcgcagggagagagaccgaagccacctttcccggagctccgcaaagctgtgccaggtgaccgcacggcaggtggtggcccggactccgagctgcagccgcaagacaaggtctctgaacacatgctgcggctctatgacaggtacagcacggtccaggcggcccggacaccgggctccctggagggaggctcgcagccctggcgccctcggctcctgcgcgaaggcaacacggttcgcagctttcgggcggcagcagcagaaactcttgaaagaaaaggactgtatatcttcaatctgacatcgctaaccaagtctgaaaacattttgtctgccacactgtatttctgtattggagagctaggaaacatcagcctgagttgtccagtgtctggaggatgctcccatcatgctcagaggaaacacattcagattgatctttctgcatggaccctcaaattcagcagaaaccaaagtcaactccttggccatctgtcagtggatatggccaaatctcatcgagatattatgtcctggctgtctaaagatatcactcaactcttgaggaaggccaaagaaaatgaagagttcctcataggatttaacattacgtccaagggacgccagctgccaaagaggaggttaccttttccagagccttatatcttggtatatgccaatgatgccgccatttctgagccagaaagtgtggtatcaagcttacagggacaccggaattttcccactggaactgttcccaaatgggatagccacatcagagctgccctttccattgagcggaggaagaagcgctctactggggtcttgctgcctctgcagaacaacgagcttcctggggcagaataccagtataaaaaggatgaggtgtgggaggagagaaagccttacaagacccttcaggctcaggcccctgaaaagagtaagaataaaaagaaacagagaaaggggcctcatcggaagagccagacgctccaatttgatgagcagaccctgaaaaaggcaaggagaaagcagtggattgaacctcggaattgcgccaggagatacctcaaggtagactttgcagatattggctggagtgaatggattatctcccccaagtcctttgatgcctattattgctctggagcatgccagttccccatgccaaagtctttgaagccatcaaatcatgctaccatccagagtatagtgagagctgtgggggtcgttcctgggattcctgagccttgctgtgtaccagaaaagatgtcctcactcagtattttattctttgatgaaaataagaatgtagtgcttaaagtataccctaacatgacagtagagtcttgcgcttgcagataacctggcaaagaactcatttgaatgcttaattcaatcattagtttatttttatggacttcttcctgttttttttttttttttttttgcactgccaatgcattttgtttcaaaagattatttctatagtcagaggggaatgagcaaatagactgaagattgccaccaaggaaaagaactgtatttgtttctgaatgtaacttaaagcaagatttttagtaaatatggacatctatttctctttttgtaatcaaacacaacaacttatcaaactgtttttagaactgttagagaacacactggtttatttttgtaatgttctttgaaaacagaatggagaagcagcaatagcttgtcatttatctcatttaatgactaatgggaaatagagaacaatttcgcgttttgaattaggcttattgccttagaatcctgagaaagtgctaaataatcaactctgatgtttttcttaagttcttgagactcttgtttatccttgtttttcctccacaagtcattgtctaagtgtaatggaaagtttatgctgagcgttagtgtgtatgtatgtgcgtacatgcgccaggtgcctgtgccctctgtaggatggtttgcttaatatggttttataattcagtttacacaggattctttattttttttaattttgtattttggcaaacaccattcagttataagaactttgccaaatatgatagaataattcaagagcatatacagagagttaccacttgacccagctatttaattgcaaatacagttgttttcatttcatttcctaccagaaaaaggaatcagaaacctagtttttgaaaacacaagtgtaattcctcttttgtacttctttttcacaaatgcttttatttattctaaattgaatttaaaaatccttcctaaagccattaactctttaattctcctgatatgcctttacttcctatgaagttattggtagatgttgaggcccaaaaactggtagaatattgaagatcttcttaaatgaccaatttaaccataaccaaatattgaatatcattcttcagtcacatctaagtcaggcactttttcacatagatcagggcttttggctcagtcacgaaatctacaagttagcaaagcttacaaaacattattcgtcaggtatgggaatcaaatatagacacttgtttgtctttgctttccatttctatgtgtcacatacatatatgtgtcctcttataactttagtcttcaaaattatttcaatatccttcttctcactatatttatttgtgtgatggaaatgctttcaggccgtagatcattgttggtgttaatctgtggttaatcctcattttagttccgtcttatctgatacttagaaatatctcagccattttggaggctgtgcagtatcagaagacgtggagtttgttctgtctctgcctgtagctaattatggtggttcagtcatttaataaatatgttttgagcatctattttgtgaaaggcactgtgttacctgtgtgtctttagtgtcctcactggtaaaatgaagaggctggccatgagctggaagggttaagtttataattccagctatttcacacccgtcttccttgaaggaatgatagtgatagatataaaaacactgtaagtccctcttttaataaactaaatgaaagaacatcctatacttcgctgtttgtaaattagtatggcattcgctttggtttaagtggtattttattgcaaacccattaaaagaataactcatgaaaagaagctctttgacaccttggggtacacaaatgttggtgtgggtgtgtgttaattctgtgagtgagacacaccagttctaaaaaaaatgagtgaagttctggtgcctgagttaccatgctttcttctagttcttacagtagcataaaattaaagattcaaagtgagatggaggataaaattactttttaatacatgttctcaaacatttgaaaataaaagtatatgatagaagggggccagagtgtggccaccatcctgatcgtactgtttttcaataaagaaaactttttcattggtagatttggtgaaattctaaatttaggtttttttctagagctgtatcaaccaaaacttctggcaattcccagtatcacttcttagccttcttatatccaaatgcctgtttattacctttcttaatttgaatcaatgcctagttattacagattgcaccccacaatggccaaaaacccactacataataaaatttacaggtactaactagttaagattatattttaagtagcaattgatataaaattacaacacaatgaaagaacttgggtaatctcttagcaatggaaataggttttaaccagcagtttttctgggtgctttgtaactatcattttactaatgaattgaggatgtattatggtttaaattggaagagttttattcccaaagaataaagcaagattatctttcagtagtagagattgaagtaaatgtattaatattttaattaatacagatttactaagagtagttagaaaatttagtaagtgcctgttttacaaattgttaggtactagtttctgtataattcctacacagaagctttagaaatctcctgatattaaattattaaattggcattcatgaaaagagaagctacaattataaactccatttgctaaatcatgcataatactctctctctctcttcccccacaagtaatctctctaccccatgcagtgtgcacacacacacacacacagtcagttactgaaaaaaataattctttttctttttttttttaaatggagtttcactcttgtcgcccaggctggagtgcagtggcgtgatctcggcccactgcaacctccacctcccaggttcaagcagttctcctgcctcagcctcctgagtagctgggattacaggtgtccgccaccatgcctggctaatttttttatttgataaaaagaattctttttctcaataactgttctcttgaattcaaattaagggactgccaaagtcaattagaatattttaaaaatactttgttgtaacctgtgtaaataatatacaatttacaggatttgggattgtagaacttaaactggaagactggattcctcagatctcaggactataacattccagataaatttttacattccctttgctgtatattaactgatgatcatttatatgttaagattttttaccttaatatttctgaataaaactcttattgcccatttaatattttcataggcaatcaaatgtgagtaatactgctaagagtctgatttattaaaaatatttgtataattcattcagtttagtttttcagtttagtctttctgctttcacttttctctgtgctaacaagtaactaatgtctgggcattgacttcttattgaatcaaagttgggttaggcatagctatgcacacctgatgtgtaagattaaagaagagattaaataagaaatcttgggtaagttggacttttctgtatagctcttttttcctctgagttgtattttaatgtagtttataagtgataaaatgatccttgttttctaaaagccagtccttcccttcagctttccacagtttctgtaaatgtttaatacttgtacagtcaatggcaattttaaatatatatatatatataatatatgtatatggaaaaggttcaaagatgcttttaatttatttaatgactattgccttcctataataataattttcatccttaattatgataatacttttagcaagaaaaattcctttttactacagtttttagatgcaaaatgcagtttggttctttagtcaaatccacttagagggtatattgcagtgaaactgtgaaggatacttcactaccaatgtataagctttgttgaatttgtatcattttctttcagtaatgaaaagctattcattatacagtatggaaataaaaattgcttcattga

SEQ ID NO: 111763 - DNA, 1917 bp, Homo sapiens
  Payload ID: 1895
  Gene Symbol: BMP4
  Gene Name: bone morphogenetic protein 4
  Uniprot ID: P12644
  ENST ID: ENST00000245451
  CDS Start-End: 395-1621
ggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaa

SEQ ID NO: 111764 - DNA, 1784 bp, Homo sapiens
  Payload ID: 1895
  Gene Symbol: BMP4
  Gene Name: bone morphogenetic protein 4
  Uniprot ID: P12644
  ENST ID: ENST00000417573
  CDS Start-End: 265-1491
gaaggaagtggcgggggaaggagtgtggtggtggtttaaaaaataagggaagccgaggcgagagagacgcagacgcagaggtcgagcgcaggccgaaagctgttcaccgttttctcgactccggggaacatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggt

SEQ ID NO: 111765 - DNA, 1112 bp, Homo sapiens
  Payload ID: 1895
  Gene Symbol: BMP4
  Gene Name: bone morphogenetic protein 4
  ENST ID: ENST00000559501
  CDS Start-End: 298-1112
gtctcattatattcaaatattccttttaggagccattccgtagtgccatcccgagcaacgcactgctgcagcttccctgagcctttccagcaagtttgttcaagattggctgtcaagaatcatggactgttattatatgccttgttttctgtcatcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggcctt

SEQ ID NO: 111766 - DNA, 505 bp, Homo sapiens
  Payload ID: 1895
  Gene Symbol: BMP4
  Gene Name: bone morphogenetic protein 4
  ENST ID: ENST00000559642
  CDS Start-End: 175-505
gctaaaggagcacaatgcctgatgctgcaggagaaacattaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccgg

SEQ ID NO: 111767 - DNA, 1708 bp, Homo sapiens
  Payload ID: 1895
  Gene Symbol: BMP4
  Gene Name: bone morphogenetic protein 4
  Uniprot ID: P12644
  ENST ID: ENST00000559087
  CDS Start-End: 186-1412
ggcagaggaggagggagggagggaaggagcgcggagcccggcccggaagctaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaa

SEQ ID NO: 111768 - DNA, 495 bp, Homo sapiens
  Payload ID: 1895
  Gene Symbol: BMP4
  Gene Name: bone morphogenetic protein 4
  ENST ID: ENST00000558961
  CDS Start-End: 1-315
ttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtggg

SEQ ID NO: 111769 - DNA, 1705 bp, Homo sapiens
  Payload ID: 1895
  Gene Symbol: BMP4
  Gene Name: bone morphogenetic protein 4
  Uniprot ID: P12644
  ENST ID: ENST00000558984
  CDS Start-End: 188-1414
gaaaaacagagcctgtctgcggtggagtctcattatattcaaatattccttttaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaag

SEQ ID NO: 111770 - DNA, 458 bp, Homo sapiens
  Payload ID: 1895
  Gene Symbol: BMP4
  Gene Name: bone morphogenetic protein 4
  ENST ID: ENST00000609748
  CDS Start-End: 1-90
aacaccgtgaggagcttccaccacgaaggtcagtctcttcccccagtctgcgtgggggagggctggtgggactggctagaggggcagtgaaagccctggggaagaagagttcgggttacatcaaagccccagtccaggaggctgaggaacagagctgcttacctccaagaatttgcagagctgccgccgaacttattttttggagacagagggggaggtgttcaggggaaggggaatgacagcactcagacgtgggctagccccagcggtgtgtttttgctatatcaaagccttttctgctaggttttctgcccgtttttttcaaagcacctactgaatttaatattacagctgtgtgtttgtcgggtttattcaataggggccttgtaatccgatctgaatgtttcctagcggatgtttcttttccaaagtaaatctgagttattaatccaccagca

SEQ ID NO: 111771 - DNA, 3952 bp, Homo sapiens
  Payload ID: 1896
  Gene Symbol: BMP5
  Gene Name: bone morphogenetic protein 5
  Uniprot ID: P22003
  ENST ID: ENST00000370830
  CDS Start-End: 700-2064
ctggtatatttgtgcctgctggaggtggaattaacagtaagaaggagaaagggattgaatggacttacaggaaggatttcaagtaaattcagggaaacacatttacttgaatagtacaacctagagtattattttacactaagacgacacaaaagatgttaaagttatcaccaagctgccggacagatatatattccaacaccaaggtgcagatcagcatagatctgtgattcagaaatcaggatttgttttggaaagagctcaagggttgagaagaactcaaaagcaagtgaagattactttgggaactacagtttatcagaagatcaacttttgctaattcaaataccaaaggcctgattatcataaattcatataggaatgcataggtcatctgatcaaataatattagccgtcttctgctacatcaatgcagcaaaaactcttaacaactgtggataattggaaatctgagtttcagctttcttagaaataactactcttgacatattccaaaatatttaaaataggacaggaaaatcggtgaggatgttgtgctcagaaatgtcactgtcatgaaaaataggtaaatttgttttttcagctactgggaaactgtacctcctagaaccttaggttttttttttttttaagaggacaagaaggactaaaaatatcaacttttgcttttggacaaaaatgcatctgactgtatttttacttaagggtattgtgggtttcctctggagctgctgggttctagtgggttatgcaaaaggaggtttgggagacaatcatgttcactccagttttatttatagaagactacggaaccacgaaagacgggaaatacaaagggaaattctctctatcttgggtttgcctcacagacccagaccattttcacctggaaaacaagcgtcctctgcacctctctttatgctggatctctacaatgccatgaccaatgaagaaaatcctgaagagtcggagtactcagtaagggcatccttggcagaagagaccagaggggcaagaaagggatacccagcctctcccaatgggtatcctcgtcgcatacagttatctcggacgactcctctgaccacccagagtcctcctctagccagcctccatgataccaactttctgaatgatgctgacatggtcatgagctttgtcaacttagttgaaagagacaaggatttttctcaccagcgaaggcattacaaagaatttcgatttgatcttacccaaattcctcatggagaggcagtgacagcagctgaattccggatatacaaggaccggagcaacaaccgatttgaaaatgaaacaattaagattagcatatatcaaatcatcaaggaatacacaaatagggatgcagatctgttcttgttagacacaagaaaggcccaagctttagatgtgggttggcttgtctttgatatcactgtgaccagcaatcattgggtgattaatccccagaataatttgggcttacagctctgtgcagaaacaggggatggacgcagtatcaacgtaaaatctgctggtcttgtgggaagacagggacctcagtcaaaacaaccattcatggtggccttcttcaaggcgagtgaggtacttcttcgatccgtgagagcagccaacaaacgaaaaaatcaaaaccgcaataaatccagctctcatcaggactcctccagaatgtccagtgttggagattataacacaagtgagcaaaaacaagcctgtaagaagcacgaactctatgtgagcttccgggatctgggatggcaggactggattatagcaccagaaggatacgctgcattttattgtgatggagaatgttcttttccacttaacgcccatatgaatgccaccaaccacgctatagttcagactctggttcatctgatgtttcctgaccacgtaccaaagccttgttgtgctccaaccaaattaaatgccatctctgttctgtactttgatgacagctccaatgtcattttgaaaaaatatagaaatatggtagtacgctcatgtggctgccactaatattaaataatattgataataacaaaaagatctgtattaaggtttatggctgcaataaaaagcatactttcagacaaacggggaatttcctaaaattagtctggctcattttgactcttttcctatgtacaatatcatgtatatagtcatttttatttatttaaacgtatatattctcttctgtggaggctttatcaataaaatctatttcataggccactacattatacaatagatcatctagtataattttcaatgggttatgctgagtccattcaattccatttcaacatttttttctaatacaattttacataattttctgagattagacagaactcctttgactgtttaatattgtggaaggaaattgaataatttagttatattgtgccaatgaaaaccatgatagaatatttatttagaaataagacttaaaaaaataacaacccaaacaaaaattcttggataaacacaatttctcttttagagttcctgcttcattagataaagtgaaatgttgaactggatttgaataaataaacggtaggcagaacatagaagctgaaagattgcacagaattgttttaactgtttgctttaacagaagtggtgtaactgtaggagcatgttcctttttggcttgtggattgtagattttgcaaagagctcaaagcttcaggagacaggcttgagcctgtgtccatagctttccaagttaacactaattgtagtacaaccttcttacctcaaataaatcatgtctgcctattatctagaacactactgctgcagaatttttttttcagatttaaaaacctagtccaaaataaagaaacatttacatgtgctccactttcctccccacaggcaagagtcactgcatgcgtaaaatgtacaagagcagaagatgccgaaagaaccattttctttagctctcctttataactgagtttgctgattgatgtgatgcaagggattttatttagaagtaaaagcactgaaactaaactggaggaaattaccaaaagtcccagaatggctttgacagaattgccatttctaaagaacagctgaaattcatttttcatatctttgagagtgagctcaatgaaaaccttattttgtaaaggcattttgtaaaccttcttccaagcacaaataattccaaacaggaaggttctgttgtgtgtgtgtgtgtgtgtgtgtctgtgtgtgcatgtgtgttcttccctctaaaattaatttattttctctatctattagaatgccctctaaggcctttctttaacacacactgactttttgaagaatgatctttagattgataacttgctatttatggtgactctgtggttaggcttatttaccgttaatctaaagtattcataaagcaccatttattaatcatccttttggatctttcaaaccaaacgtataccaaaaatgtcttcaaaaatgttatggctttgtttgtaattcgggtatattaaaatgttgttttgaaatacagtttatcttaaagaaaatttgacagtaactatattaaggggtacattaagtaatatatttttaattaatggtgtaccattgagagaataagaaatggaagtctattgttttattctttaaatgtgctgtttaaatatatttccatattttaaaatatattaaacagatgctaatttctgctgttcttgatttggttctttatttaaaaggaatacaaaatgtaagtatatcataaattgagacaataagaatatttatcaaatgtaaactgtttgtggatcacatgattctttatgttgttcttaattgccaaaattgttttttgtgttgttaataattatctcactattaaatgtgcaaagcaacaatccatgaa

SEQ ID NO: 111772 - DNA, 2780 bp, Homo sapiens
  Payload ID: 1897
  Gene Symbol: BMP6
  Gene Name: bone morphogenetic protein 6
  Uniprot ID: P22004
  ENST ID: ENST00000283147
  CDS Start-End: 160-1701
cgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcagcggcggcgcgtccccactgaccagcgcgcaggacagcgccttcctcaacgacgcggacatggtcatgagctttgtgaacctggtggagtacgacaaggagttctcccctcgtcagcgacaccacaaagagttcaagttcaacttatcccagattcctgagggtgaggtggtgacggctgcagaattccgcatctacaaggactgtgttatggggagttttaaaaaccaaacttttcttatcagcatttatcaagtcttacaggagcatcagcacagagactctgacctgtttttgttggacacccgtgtagtatgggcctcagaagaaggctggctggaatttgacatcacggccactagcaatctgtgggttgtgactccacagcataacatggggcttcagctgagcgtggtgacaagggatggagtccacgtccacccccgagccgcaggcctggtgggcagagacggcccttacgacaagcagcccttcatggtggctttcttcaaagtgagtgaggtgcacgtgcgcaccaccaggtcagcctccagccggcgccgacaacagagtcgtaatcgctctacccagtcccaggacgtggcgcgggtctccagtgcttcagattacaacagcagtgaattgaaaacagcctgcaggaagcatgagctgtatgtgagtttccaagacctgggatggcaggactggatcattgcacccaagggctatgctgccaattactgtgatggagaatgctccttcccactcaacgcacacatgaatgcaaccaaccacgcgattgtgcagaccttggttcaccttatgaaccccgagtatgtccccaaaccgtgctgtgcgccaactaagctaaatgccatctcggttctttactttgatgacaactccaatgtcattctgaaaaaatacaggaatatggttgtaagagcttgtggatgccactaactcgaaaccagatgctggggacacacattctgccttggattcctagattacatctgccttaaaaaaacacggaagcacagttggaggtgggacgatgagactttgaaactatctcatgccagtgccttattacccaggaagattttaaaggacctcattaataatttgctcacttggtaaatgacgtgagtagttgttggtctgtagcaagctgagtttggatgtctgtagcataaggtctggtaactgcagaaacataaccgtgaagctcttcctaccctcctcccccaaaaacccaccaaaattagttttagctgtagatcaagctatttggggtgtttgttagtaaatagggaaaataatctcaaaggagttaaatgtattcttggctaaaggatcagctggttcagtactgtctatcaaaggtagattttacagagaacagaaatcggggaagtggggggaacgcctctgttcagttcattcccagaagtccacaggacgcacagcccaggccacagccagggctccacggggcgcccttgtctcagtcattgctgttgtatgttcgtgctggagttttgttggtgtgaaaatacacttatttcagccaaaacataccatttctacacctcaatcctccatttgctgtactctttgctagtaccaaaagtagactgattacactgaggtgaggctacaaggggtgtgtaaccgtgtaacacgtgaaggcaatgctcacctcttctttaccagaacggttctttgaccagcacattaacttctggactgccggctctagtaccttttcagtaaagtggttctctgcctttttactatacagcataccacgccacagggttagaaccaacgaagaaaataaaatgagggtgcccagcttataagaatggtgttagggggatgagcatgctgtttatgaacggaaatcatgatttcccttgtagaaagtgaggctcagattaaattttagaatattttctaaatgtctttttcacaatcatgtactgggaaggcaatttcatactaaactgattaaataatacatttataatctacaa

SEQ ID NO: 111773 - DNA, 4013 bp, Homo sapiens
  Payload ID: 1898
  Gene Symbol: BMP7
  Gene Name: bone morphogenetic protein 7
  Uniprot ID: P18075
  ENST ID: ENST00000395863
  CDS Start-End: 507-1802
cgaggcggcctcttgtgcgatccagggcgcacaaggctgggagagcgccccggggcccctgctatccgcgccggaggttggaagagggtgggttgccgccgcccgagggcgagagcgccagaggagcgggaagaaggagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctaggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacacccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggctcttt

SEQ ID NO: 111774 - DNA, 1746 bp, Homo sapiens
  Payload ID: 1898
  Gene Symbol: BMP7
  Gene Name: bone morphogenetic protein 7
  ENST ID: ENST00000395864
  CDS Start-End: 221-1318
cgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcc

SEQ ID NO: 111775 - DNA, 890 bp, Homo sapiens
  Payload ID: 1898
  Gene Symbol: BMP7
  Gene Name: bone morphogenetic protein 7
  ENST ID: ENST00000433911
  CDS Start-End: 1-890
cccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagcacaggtacctgctgcatgccatgcctgagggcatcgaccagaacgaaccagacacgagtccctgccctctggaagctcacgttccagcagaggagaggacatggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaacc

SEQ ID NO: 111776 - DNA, 1857 bp, Homo sapiens
  Payload ID: 1898
  Gene Symbol: BMP7
  Gene Name: bone morphogenetic protein 7
  ENST ID: ENST00000450594
  CDS Start-End: 508-1746
ccgaggcggcctcttgtgcgatccagggcgcacaaggctgggagagcgccccggggcccctgctatccgcgccggaggttggaagagggtgggttgccgccgcccgagggcgagagcgccagaggagcgggaagaaggagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtgggtgtcacgccatcttggggtgtggtcacctgggccgggcaggctgcggggccaccagatcctgctgcctccaagctggggcctgagtagatgtcagcccattgccatgtcatgacttttgggggccccttgcgccgttaaaaaaaaatcaaaaattgtactttatgactggtttggtataaagaggagtataatcttcga

SEQ ID NO: 111777 - DNA, 1692 bp, Homo sapiens
  Payload ID: 1899
  Gene Symbol: BMP8A
  Gene Name: bone morphogenetic protein 8a
  Uniprot ID: Q7Z5Y6
  ENST ID: ENST00000331593
  CDS Start-End: 347-1555
ggtcgctgccggagctcgccggtcgcccctgcgctgcgcggaccgcagccacagccggactggtgggaacggcggcgacagacggattggctgacagtcccagccctcagaacagccccggcctcgaagcgttggcgtctgcgtccgcgtcagcgtccgcttgtcccggagccggggcaggtgcgcgcggggggcgctccagggaccgcgctgaggccgcagacgccgcccgccgagccccgccccctgctcgccgaactcagctccccgttcgccgtcggggcgtccccgggcccaggggcggcggcggagctgatgtgcgcccgctgagcgcccccggcccgccatggccgcgcgccccggaccgctctggcttctgggcctgacgttgtgcgcgctgggcgggggcggccccggcctgcgacccccgcccggctgtccccagcgacgtctgggcgcgcgcgagcgccgggacgtgcagcgcgagatcctggcggtgctcgggctacccgggcggccccggccccgcgcgccacccgccgcctcccggctgcccgcgtccgcgccgctcttcatgctggacctgtaccacgccatggctggcgacgacgacgaggacggcgcgcccgcggagcagcgcctgggccgcgccgacctggtcatgagcttcgtcaacatggtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggacgggcacagcgtggatcctggcctggccggcctgctgggtcaacgggccccacgctcccaacagcctttcgtggtcactttcttcagggccagtccgagtcccatccgcacccctcgggcagtgaggccactgaggaggaggcaaccgaagaaaagcaacgagctgccgcaggccaaccgactcccagggatctttgatgacgtccgcggctcccacggccggcaggtctgccgtcggcacgagctctacgtcagcttccaggaccttggctggctggactgggtcatcgccccccaaggctactcagcctattactgtgagggggagtgctccttcccgctggactcctgcatgaacgccaccaaccacgccatcctgcagtccctggtgcacctgatgaagccaaacgcagtccccaaggcgtgctgtgcacccaccaagctgagcgccacctctgtgctctactatgacagcagcaacaacgtcatcctgcgcaagcaccgcaacatggtggtcaaggcctgcggctgccactgagtcagcccgcccagccctactgcagccacccttctcatctggatcgggccctgcagaggcagaaaacccttaaatgctgtcacagctcaagcaggagtgtcaggggccctcactctcggtgcctacttcctgtcagg

SEQ ID NO: 111778 - DNA, 4822 bp, Homo sapiens
  Payload ID: 1900
  Gene Symbol: BMP8B
  Gene Name: bone morphogenetic protein 8b
  Uniprot ID: P34820
  ENST ID: ENST00000372827
  CDS Start-End: 377-1585
actcgcgggaaccgcaccaagcgggtggctgcaggagctcgcccatcgcccctgcgctgctcggaccgcggccacagccggactggcgggtacggcggcgacagacggattggccgagagtcccagtccgcagagtagccccggcctcgaggcggtggcgtccgcgtcctctcgtccaggagccaggacaggtgtcgcgcggcgggcgctccagggaccgcgctgaggccgcggtcgccgcccgtcccgccccgccccgccgcccgccgcccgccgagcccagcctccttgccgtcggggcgtccccaggccctgggtcggccgcggagccgatgcgcgcccgctgagcgccccagctgagcgcccccggcctgccatgaccgcgctccccggcccgctctggctcctgggcctggcgctatgcgcgctgggcgggggcggccccggcctgcgacccccgcccggctgtccccagcgacgtctgggcgcgcgcgagcgccgggacgtgcagcgcgagatcctggcggtgctcgggctgcctgggcggccccggccccgcgcgccacccgccgcctcccggctgcccgcgtccgcgccgctcttcatgctggacctgtaccacgccatggccggcgacgacgacgaggacggcgcgcccgcggagcggcgcctgggccgcgccgacctggtcatgagcttcgttaacatggtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggacgggcacagcgtggatcctggcctggccggcctgctgggtcaacgggccccacgctcccaacagcctttcgtggtcactttcttcagggccagtccgagtcccatccgcacccctcgggcagtgaggccactgaggaggaggcagccgaagaaaagcaacgagctgccgcaggccaaccgactcccagggatctttgatgacgtccacggctcccacggccggcaggtctgccgtcggcacgagctctacgtcagcttccaggacctcggctggctggactgggtcatcgctccccaaggctactcggcctattactgtgagggggagtgctccttcccactggactcctgcatgaatgccaccaaccacgccatcctgcagtccctggtgcacctgatgatgccagacgcagtccccaaggcgtgctgtgcacccaccaagctgagcgccacctctgtgctctactatgacagcagcaacaatgtcatcctgcgcaagcaccgcaacatggtggtcaaggcctgcggctgccactgagtccacccgcccggcccagctgcagccacccttctcatctggatcgggcccctcagaagcaggaaaccctcaaacccagccagaccccaggccggggcattgccagggaggaccctcacaaccacgtacatgaccctttctccttcatgccaggctcctatgctccccttgccctgccaggcatttgtgtgactgtcctgtttccagcccaggtggtctcaatcatcaggcagtgttctacccaaatgcaaacgcctctcccggaggcatgtcctggctggttctttggggttggcacagaagtcctgtctgaggtcctatccatgccccttactggctcaggtcgtgagatagatgtggaatgacctgagaggcacctggagcccactgttggccaccttgagctcttcaccatccatcacagggtgtggtgtgtgtagtcagggtctggttggctccccattgcctgcccgaggtgcaaggtggggtataaaactggataacccctgaagtattgtatattcatggatctgaagcactgatccactggtcacaggtagacatgtggagtcaactcaagaaaaagctgagtgaacagcatgatttagggctaaagccaatggcatttatcttcccttgtcttcctgctttgcatttgcctctgccatctaggaaagacatgtaagagcatggacattttactttggagaaacagaaaaatcttggggcttccaattgacccatctatctgccaccatgttgccccaccaggagctcagctctgtggagttttccctttgctgagcaagcatgtggttgcattgggtggcccaggatgacaatgcacagcacagatgccatcatttccctttcccctctgaatggcagacatcagtaatcaatctggaatgtttttcttccaaatctgagtggaattttcaaatgatcagcacagccactgccaacagatatgatgtaaagtgaaacctggttgccatcttctgccatgctgaggagcagtccatccctgcccgagcatgtatcggcaacatgggcagcctgtgaccgggtctggggcgaggccaggggccatcaaaaacaggctgatcaccaaagtcagtgtcaccctggatgcccagcagccctgtcctgtgtcttgggcctgtgagtcaaagaaaaggtccttttcagggagtgacaagtagtaattaggctgagttgggtggagaggtttgtctcagcctctgctgttctcggaaactgctgttctccttggagcagccactgggagttggagtgtttatttgatttctgacttgctaagcctgtaatttacctgctggaatagacagagtccagctgcccaaaccgtgtcattaaaagcagatcctgcgcccgccccatccacaggcacagcccggcagagtggttccacctccccatgggcccaaggatgcgcctctctggagttcacgtgctgcacccccagggaggggcctggggaaagctggtccagcagcaggggtggaggctggggccacactgcgggacagcagcccctccacctggaccagggagggcctccatgtgcaagcgcagaggaagagaccctcccatgtacgcaaagggcagccccaggctgtctggaagttggagaattccctatcagcacagggatctcagctctggcctggaggtgaagagacctgccttgtaggtggcttccttatctgcgcctccattttctatctgcactttttgatctccaaacaaccttcagccaaagaatctgtctaccaactcctcatagtgagccagaagcagcctcataaccctgaatgtggggctctggtggctgtcacgaagcagagttggcacataacatggaacctggccaggcatggtggctcacacctataaccccagcactttgggaggccaaggcaggcagatcacctgaagtcaggagttcaagaccatcctggccaacacagtgaaaccccatctgtactaaaaatacaagattacctgggcatggtggtgcatgcctataatcccagctactcaggaggctgaggcagaattgcttgaacctgggaggtggaggttgcagtgagcagagatcacaacattgcacttcagcctggtgacatgagcaaaactgttgtctcaacaaaatgaaattatggaacctgtttgccatcctagtatttacttaattgttccttcttaacatcaaagatggtcttctaggcaattgtaaattttaaattagccagttattttgacaattaattttttactccacctgtatctttagtgcccagccaatgatctggcatagttaggggtgcaccaagaatgtctgtaaactacctgaaggtttgtagatatggagtacaccttacccattaatcaagctgtgcatagcaggaaccaatacgagccgtgatcctcctggttcatacagaacaatggaaaaacataaggctttgtctacctagttggccatcagactttcagcaacttttatcatccagatagtcaccaaatgaaataaaatagaaaaatcccttgagcaatgaaacaattgtgaatgaacacaaagtccatgaatttaatccttatccgtttgctgagccaagcatgtgcatctgcagtgggtggcccaggctggcagcacagataccaccatttcccttttctttgctcagggcatggcctgtttatctcgttgcaccagatgagggttggaaggatgatggtggtggttgtttcagatctactgacagcaatgagaaatcaatgacagttgacaggaagagaggacgcatacaacaggcaaaagaggaatgcccagcagtcttggtccttgcggtgcaatactggccttgaggccaagtcagcaggggattcgtagtcactaacttctaactgaggcagggaagtaacatgttctggaaaaggtccaaagaaacaggaatagaggcagtgtagcaagaggcagatttttggtgccaaatagatttgaatcctggttctgcttcttcctttgtagagtatgatattggttctttcctcccaaagctattataaagactaaatatgtacacaaatctttgggatgtctgacatataaatgcttaacaataggtatttgctggtattattacaaatgaatttgcttatttttgagccacttctatgtctgtccattaaaccaaaatgtgttctgca

SEQ ID NO: 111779 - DNA, 1548 bp, Homo sapiens
  Payload ID: 1900
  Gene Symbol: BMP8B
  Gene Name: bone morphogenetic protein 8b
  Uniprot ID: P34820
  ENST ID: ENST00000397360
  CDS Start-End: 365-1414
cgcaccaagcgggtggctgcaggagctcgcccatcgcccctgcgctgctcggaccgcggccacagccggactggcgggtacggcggcgacagacggattggccgagagtcccagtccgcagagtagccccggcctcgaggcggtggcgtccgcgtcctctcgtccaggagccaggacaggtgtcgcgcggcgggcgctccagggaccgcgctgaggccgcggtcgccgcccgtcccgccccgccccgccgcccgccgcccgccgagcccagcctccttgccgtcggggcgtccccaggccctgggtcggccgcggagccgatgcgcgcccgctgagcgccccagctgagcgcccccggcctgccatgaccgcgctccccggcccgctctggctcctgggcctggcgctatgcgcgctgggcgggggcggccccggcctgcgacccccgcccggctgtccccagcgacgtctgggcgcgcgcgagcgccgggacgtgcagcgcgagatcctggcggtgctcgggctgcctgggcggccccggccccgcgcgccacccgccgcctcccggctgcccgcgtccgcgccgctcttcatgctggacctgtaccacgccatggccggcgacgacgacgaggacggcgcgcccgcggagcggcgcctgggccgcgccgacctggtcatgagcttcgttaacatggtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggacggagagacgtggactggctggggctggaccaaggactccaggcttcagatgtggaaactgaggctcagcaggaccccttgggtcctcagcctccacgctcctggacctgcccaggccccggcagagagaccgctgctgtgtctgctgcagggccactgcccggccagtccgagtcccatccgcacccctcgggcagtgaggccactgaggaggaggcagccgaagaaaagcaacgagctgccgcaggccaaccgactcccagggatctttgatgacgtccacggctcccacggccggcaggtctgccgtcggcacgagctctacgtcagcttccaggacctcggctggctggtaattgctgactcttcttgtttctgaaatgacaatcaccacctgtagatcagaagtgaatctgcagggaggacatagaatcatggtgacttcaattttcttatgtatttttttcttctgtgttttccaagttttctaaagtgagaatatggtgagaaagg

SEQ ID NO: 111780 - DNA, 11255 bp, Homo sapiens
  Payload ID: 1901
  Gene Symbol: BMPR1A
  Gene Name: bone morphogenetic protein receptor, type IA
  Uniprot ID: P36894
  ENST ID: ENST00000372037
  CDS Start-End: 538-2136
agagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccggacttatgaaaatatgcatcagtttaatactgtcttggaattcatgagatggaagcataggtcaaagctgtttggagaaaatcagaagtacagttttatctagccacatcttggaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagactttcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttatagatgccttgttatctcaagaaatctgatttacataaacttatacttctttaatgctttttaaatatttattctgagcaaacaattcatgagtacatcaagtgagatagttttatttgattataacataaaataaatgtgattatatcacatcatcatcaaaaaggtttaaattaaatgggaggaaatcagcatatgtccacccattaccaaaatttgactatcatttaaggttaaaacttacaaatttgtctgcacatcaaatttcacaaatttgaaaattgccttaaccattttgattaataagtttcatctgccataattaaagtctgaagtgttcatcaagataagtaaatttgcatatggataatacccaataacttgttttttcagaatttttcaccatatgtatactgagaaatacaaatattttaatctgcgttgccgtatgatatgattgcacttagaacacccaatttacttaaatcttggtttacttttgacttgataccataatctttaaaatcatttgtcatctttttttttttttttttgagacggagtctcgctctgtcgcccaggctggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacctgcctcggcctcccaaagttcatttgtcatcttaataaaaatataaagacaggcaaagtttattggaaatgttcaaatggtgtgtggaagcaaaaaattacagccagtatatgagaccactattatggttttttaaaattaacttggtctagtaaaagtgatatcaagagttaatcttagaaacttgctcagtaaaaacattttctagtataacatgttctttaaaaagcaaatgctgccgtctttggaatcttaatctaaaaatgtggccgggcgcggtggctcacgcctgtaatcccaacactttgggaggctgaggcgggtggatcacaaggtcaggagttcaagaccagcctggccaacatggtgaaaccccatctctactaaaaataaaaaactcagccaggcgtggtggcgggtgcctgtaatcccagctactcgggaggctgaagcaggagaattgcttaaaatcagaaggtggaggttgcagtgagctgagatcgtgtcactgcactccagcctgggcaaaagagcgaaactccatctcaaataaacaaacaaataaataacaaaaaacaaaaatgttgcattaaacttagttcttgtctctcctttccactcttattcttaaatctgaagctcatcgactaagtgaaatatttaaagaatatgataggccagcaagaagaagtattatgtagtaccatagttagtaaattcgtaaaaccttggaagccattatttggtcccacttgcaatttagtgtttttgaagtgtgtagcttcattcagatagctctttaaataattaaaatataaaagcaaacaacccaaactacctgactataaacaggaaaagttaaccctcaaagagagttcttgtgaattctctttatgctggcaaatagctctaggattaaaggcacattagggtttccttcagtttgtttattctaagcttttactgtgctttttactgaacaagtttctgatgtataaaacttgcatctgatttctttggaaatattttcacaaaagttattttaatcagtatttttacattgcctttccagtgtccagaagtgtttctaaacttagaaagtgacctatagttttttaaaattatgttttcctagaacgtgccaaattttgatttactctaacaatcagtacttttcttcagatgctttgttctgtttagaacaaaaatgcactatagtttttaaagaatcatgcatctttgggttggcccaggatcaaatttgatattgaataatttattccagggcagctttcataaacatacttcatagatgttgttttgaaatgtttctaaatatctaaaatcatttcaacagcagaaatgatttttattttaacaaaagattatgatagcccttgtagtgtttaaaagtggtcatatttattactgactttgagtcaggtgttaaaatagcagtgccacagctcgtctcttgccttagtgtgctgctgtgagagtcacagtggaaactgcagggaggaggtgtgttcctaagaaccaaaatccagcacagcatcctgtgaagccacgtgtaatgatggtcccataaggaaagtatgtgaatatggctcttgtaaaggattaactattgtaattttagcttatgctctgtattctgttttctatggaattatttaagcccttttagtgacctttgtcctggcccatttaaaaactaaaatgtagtatatattgtataaaatggaaatatcattattgcttcattaggggaaactgtacataggcattgaaagaagggtaaaagcaagcagttttatcaggcagttgtaaaacaccaaaaatatagattcgtctttgacgtgtaacacactaaatgtattttgtacagcatctggtttaaaaggtgccttaagagtttaccattacttgctttgttctatatacagattatgtccaatgtatcattttgaagtaaataaccttattttagtatactttagtgatgtgttttgtgatgctacactcagacggtattgtgcatcagaagtcatctgttgagatttttgtaatgattaagttagtgtatatacatatgttcctgagatgtacacttcaactaccagaaacccagtatggagcacaggtaggtacacgcttgccctgtggagatagagaacttctaaacctatcacggtgcaggggtttttcctttaaaaaacaagacaaaacattgttttctttttcctttttttttttttttttttgagacggagttttgctcttgttgcccaggctggagtgcaatggcacgatctcagctcactgcaacctttgcctcctgggttcaagcaattctcctgcctcagcctcccgaatagctggaactacaggtgtttgccaccatgcctggctaattttttgtatttttaatagagacagggtttcaccatgttggccaggctggtctcgaactcctgacctcaggtggcccacttgccttggcctcccaaagtgctgagcttacaggcatgagccaccatgcctggccaaaacattgttttctgattatggaaatgtactcatggcagaaaatttgggaaacaacagcaaataataaagcaaataaaaatcactcaaaattctattgccagacattatcactatatacatttgagtgtttcttttcaatctttttttttgagagagtcttgctctgtcactcagggtggagtgcagtagcgcgatctcggctcagtgcaacctctgccccctgggttcaagtgattctcctgcctcagcctcccaagtagccgggattacaggtgtgcaccaccacgcccggctaatttttgtattttagtagagatgcggtttcaccatgttggcccaggctggtctcgaactcctgacctcaagtgatctgcctacctcagcctcccaaagtgctgggattacaggagtgagccactgcacccggccttattcttttttatgttgcattttttgtaatattaggatcctagtatgccattaaatagccattgagaactttttttttaatgactgcacaatatttgactaagaagatggagtaatttctgtgctcaatcccctattgaatatttggattattttcattgttttgaaaaatagatattaagcatccttatacataaatctttattttcttatattacatttctgaaaatgagactagtggatatgaacttttaaaagatcctttaagatggaaaaactaaggttcttggaaaacattgccatattgctactcacaaagcttttcattttcattcctgctagcagttcatgagcttagagcgatgggatgcatttacctggccttaagatgctcctgctgcaatgggaagtgaagccttggatagctttcctcctcctgtgcaatactttcttgtcattttcccacctgcactgagtcccaccgccagtcagggctgttttcaggtgtatgtgaattcatcccagcagtgtgccttctgctgccttttcctagggaactgaacatgttaaatcacagacgcgatgtggcactgattattgttcctcaaaagaaatgcgtgtctgaagatagcctcttacagattcctcacgggagtctctgttcagtgtcattgtaagtttctcagaataatcgcaggcgctctgatgcagcctggtaaagaagactcagtgatttctgggaactgcaaatgcttgccagctttccttctgtctgtggaaacactgaataaatgtattcatttctcctttccagcaatctgttagtctcactgctccattccaaggtttctttaatattattaacagagcagacattaagaaacagaattgtctaatccttgttcttccaaaataggtttaatccttgtagatagtttcaagcagacagtaagtcagttactaagttttcacttggagaaacatttgctgatagtagtagcatattgaccatttctgacatgtcatccttatatcaagttaggtgcacgctcctacacagccttggctcagcgcttggagcatacagtcttgactgggtggacataaaccgctgaaagtggccagcagtgagcagaggccacctactatcagcggcactgctgcaggcatggagacttaaatgtgtgagtgctggtataagcagaagtgggagagtcacctcgatgctgggatccagatggcggcttatttcaagtgcagtggcacatacaaaaaatatttttggaagggagcaaggactagggctgaaaggttcattcataatctttttttctttttttttttaggtggagtctcgctctgtcacccaggctggagcgcaatggggtgatcccagctcactgcaacctccacctcccgggttaaagcaattctcctgcctcagccacctgagaagttgggattacaggcgtgcaccaccacactcagctaattttgtatttttagtagagacggggtttaccatgtgggccaggctggtctcgaactcccaacctcaggtgatctgcccaccttggccttccagagtgctgggattataggcgtgagccactgcgcccagcccataatctccttttgacataggaattgttaattcacatattccatcaacctattgctcctctgaatcttagcagcttcttggtctttgttcaaatgaaatctaagtcaattccatatctctcaatgtcgctacatccacctcagtgcttatatcctaattttgtcttttttagagacagtcttgcactgtcacccaggctagtgtgcagtggctgttcacaggcataatcataacgcactgtagcctcaaactcctgatctcaagccatcctcccacctcagcctcctgagtagctgggaccatgccaccatgcctggctcacattctaaacattatgcaggaagctcaaagtgaaaatcaatatggaatgtttatattgaaaatatttttggctgggtgcagtggctaatgcctctaatcccagcactctgggaggctgaggcgggcagaccacctgaggtcaggagcagcctggccaacatatagtgaaaccctgtctctaaggtacaaaaattagctgggtgtggtggtactcgcctgtagtcccagctccttgggaagctgaggcaggagaatcacttgaacccaggaggcggaggttgcagtgagctgagatcgcaccactgcattccaggctgggcaacagagcaagactccgtctctcaaaaaaaaaaaaagaaaaaaaaatatatatatatatatacacacacacacacacacatatatatatatatattcaagcaatgtgaagaaaatattgggcccccttgtttttctttaatggaagagccatttttaaaagccagtttagaatccagatgatgacatctgttgctctactgtatgactgaaatgcaggtcagtgttgaaaaacataaaaaattggaagtctccactgaaagacctacactgctgtgggagggattttaatcaagacatttcaaaagcaatttttattacttgatcctgtcctcatacttggctaggagttcagctggagatagaatctaactctgaagatgatactccatgatcttctagcatcccttgtcaccagtgagaagtctgatgtggatctaataagtgacatgttatacaggttaacttattttcaagaaatagaattttctttttattattgatgttggaagttgaaactggccatatctaaatatattcattctgtttcttagtactaatgggatcttttcttagacctgggaaattttctcccattatttcttttgtttcttcccttttttctttcttttccttttctctttctagaactttctagaacaaatctcaggtcccctagatgtttcttccataattgttactatgcttctcatatgtttcatcctaccttctacttttgtcagcccatctgagtttatttcaacagccaaatgttttattttgaaatgattccaggcttccattaaagtttcatcaatagtataaggactgccatttacccttcacccagattcataaactgctaacattgcacaattgctttgtcattctgtgtgtgtgtgtacaggaatcacagagactcatcttgtaatgtttgtaatgtccatgtatcgtgtatgcacacatttttttctgacctattagaagcaaattacagagctaatacccctttatccctaaatacttcagggatgttctattacttaaccaattatgtacaattatcagaaccaggaaagttcacattgatacaatagcaatgaccaacaataccataatctatagaccttactgaagttttgctaattgttattttggtgtggttgggttttttgtttgtttgagatagggtctcactctgtcacccaggctggagtacagtggcacagtcatagctcacttcaacctcaaactttgggcctcaagcgatcctcccgcctcagcctcccaaagggctatgattacaggcatgagccaccatgctggcctcatttcccctttccttctcaaaaggattctggctttccctactgcattcatccacgtccactacccgctccaagagagctgagtaattgtcaagccaggtttggggagctttcttgatggaggggatggaaggagggtggtgctcaggctacagcagggagagcttttctgtttttgagctaaagacataacagggtgcagaggctgagaaaaggagagttctaagcaacatgtcacgagctatgtagcctcttcacactgcttctgaaataaaatctaacagtaggagtga

SEQ ID NO: 111781 - DNA, 421 bp, Homo sapiens
  Payload ID: 1901
  Gene Symbol: BMPR1A
  Gene Name: bone morphogenetic protein receptor, type IA
  ENST ID: ENST00000480152
  CDS Start-End: 299-421
agaaaatcagaagtacagttttatctagccacatcttggaggatattacttttttggtccctattaaactatgtggcagcaagtcacaaaggaggaatcagaaagtaacctgctccccacccttggtgtgtagtccagttagcaaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggacagaatctggatagtatgcttcatggcactgggatgaaatcagactccgaccag

SEQ ID NO: 111782 - DNA, 1807 bp, Homo sapiens
  Payload ID: 1902
  Gene Symbol: BMPR1B
  Gene Name: bone morphogenetic protein receptor, type IB
  Uniprot ID: O00238
  ENST ID: ENST00000264568
  CDS Start-End: 155-1663
atatcacaggtgcaggattagtgctgcctacggtgctgggctttttagtggaaacccctagcaattctgtgcctcctcctcatgtctctcatcctagggagcctggcaaccatatatcaagcgtacagaaatcaaaacaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctca

SEQ ID NO: 111783 - DNA, 1922 bp, Homo sapiens
  Payload ID: 1902
  Gene Symbol: BMPR1B
  Gene Name: bone morphogenetic protein receptor, type IB
  Uniprot ID: O00238
  ENST ID: ENST00000394931
  CDS Start-End: 71-1579
gactggggtagtctaccccacagatgcctaactctcactatttcttctttcagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccatgtctgtttgtaggacggagaaaccgcttgggtaacttgttcaagatatgatgcatgttgctttctaagaaagccctgtattttgtgattgcctttttttttttttaagatgctttcattttgccaaaataaaacagataatgtgga

SEQ ID NO: 111784 - DNA, 5388 bp, Homo sapiens
  Payload ID: 1902
  Gene Symbol: BMPR1B
  Gene Name: bone morphogenetic protein receptor, type IB
  Uniprot ID: O00238
  ENST ID: ENST00000440890
  CDS Start-End: 22-1620
attgactgctctgctgctgcaatgggttggctggaagaactaaactggcagcttcacattttcttgctcattcttctctctatgcacacaagggcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccatgtctgtttgtaggacggagaaaccgcttgggtaacttgttcaagatatgatgcatgttgctttctaagaaagccctgtattttgtgattgcctttttttttttttaagatgctttcattttgccaaaataaaacagataatgtggatggtttaagggttatagtattatagtttaaataataacaacaaaattcttcccaggaactctgctggaaggtaaattaaaatacttgtttttccattggtaaaatattgttgcactctgtgaaccaaaagacagtctaagttggaggacatagaacggaactcatcttaaacatactccccaccccgtcttggcctcctcagaccactttggccatccctgcatttggggccgctatggtaatgtgaatgcactgggtacaaacaccgcctgtctaggaccacatttggaattcctgcaggtggccttttgcagcttcaggcaatatggaacaaatgaaggtttatgtgactctaatagaagtaattgttgataggtgttcttcagatccacttctgtttctgattgagttaggcatctctttcatggtaaaacccttttcattaaacacaaagaaagcttttttttttttttttttttttttttttttttaatgtgcagaggattgacctgtgcatgcttttgatctctcattcaaaggatcaatattaaataaaattgtcatgagctgtgttgaagacagggtgctttcaaatagaggtaatttgctcttgtgttgtaagaggaacatgtcaacaaagataggaaatgagggtgatcgtgcagatggcttgtatcttatatatgcaaaggagccaatctcagaagcacaaagaaaaaagtgtgcataccttattttgtacagataaagatgatgtctttttgttattgtctgtctgttttgtatgtgtctgagataagggatagagaggaaacatccgtcaggctaatttaactacattttattttaaaaatagagaaacataacctctagatgggacagcagaggacagttagtagaggccacaaactgttatgggctgctgtgttttgttctaaaatcaatatggttggagcatgtatatcttaggtgatcatttcacatcttaggaatgcctactcattttattttattctagtgatgctcaattcactatttaatttattatattttctcttctgtggcacttatacaaaatatctcttcacctacttagttctacagggttttaactttggagcaacatgaataaaatcatcgagaaggccaatattgtttagcaacatgaatacaatacagtttaaagttgtacacatcctgctcaactttattcatatacatttcctttctgtggttttcttttgcttcttagaaattctgttagtggttagtaaagaatttgaaagtactttctccttgctgtttttttttttttttaagacattcctcccagaatactccagggggcagtgttttataacacattttccccactgggtgattgaaggatggaggatttttgaaaatttgacagctacatgaaacatgagaaaacattttcctcacttctgaagtcggtttgcagctggtaacttgttcatccagaaaacattctaaagcaatgagactttgtgagctgtgcttacagtttgggagaatcatgaagattctttctatattttgcatttacttcccagtgcttcatagctgcattttgtttgtaactaagacagaagaatttcgtaatccttgaaattgaaaaaaaaaaaattgtgtttttaaagagtgaaaacagttagaaaacaagtagaactgtaatcagaacgctgcttcaattgatattaaaaataacctcaataataatgtaaaggttcctttctcttgtgtcagttatattcttagggatagcctagaaggaatatatggttagaactaagtgtgactaatcatctgagccttgaagagaaacttcagtgcctctaaacagatcatctacaaaacaacaggtaaacatttatgccagttaagtgggtcatgtttttgtttcttgggtttttcctaaatttaagtgaggttgggcttaccttgtagataaaattatgttttctttttggtaaatacttgaacgtggataacgtcaaatcagaatattttgtgaggaggtgatgatttgaaattaagctagatttctagggaggtgttggttccaatgaaggatgggaagaaattaaaatagtcttcaaacttcttccttattatatttggttgctttggaaaagattggtcctatcctcaatctaatttattcactattaatattttaaaaacattcctgagatacttaaaaagacccacttagcgattatagttgctcaatgaaacaagaatttatttatgcatagatttttctctgtatcttaccaaaatccactttacttagataacactaaattgttcttaaagactactcatttcccaataatcctttatgatttcaaaatttctagtggctcagaagtgaattttattttatttgtctttcacttgaataaatgagaacccagaaattaataatgttgtttattgcttactgtcaggactatttcaaagactaagaagagtttcttctaacccctccctctcaaaggaatcctaaattattagttgttagataagttttgtatgctaagatattcaggtttatagtttatgtatgtgtgtatatatataaatatatatgtatatataaatattatgttcagtttggagtctggcacaactccattatgtggattagagagtaagatattatggatgataaagtactaaatgaaacataatatttatttataaaagtgtgtagattgttaaatcacaaaaagagtgctatgaccattatgtatgaggaaacaggcctttgacctcctggaaagcactgctcaaaagtcattagtgcccatttttgaattccccaaacagaaagcttcttagaaaacatgctgagattttatttacagggaattctttgacacatttcaattggtgtgtagtcaagtatagcaagtacttaataatgactgaatttcatgttcctacagtcatacatattcattagaagttttatgttgttggtctgatctgattcttctttgtttgtgggtggaacggcactgagagaagtatagttttttaaacttgaacatgttcagtagttacattgccttagaaaacccagacacatagcagtggaaatgaaagaaatggcatcagaagtgacttaatttagcaattgtgattcctcttgtaaaacaaaacaaaaaaacaatgccatattttttggagaaaagttggcaatataggggtttcgttgtctgtttcacaagaagactcatttgttcttttgggggaaccagtgccttacagattttgtatatactgtaattattcaggactagggaacaaacaattgtattgtatttgttacagattgtatatggctttgttttaacattcccctaaataaaatggcttcattctccccttgg

SEQ ID NO: 111785 - DNA, 731 bp, Homo sapiens
  Payload ID: 1902
  Gene Symbol: BMPR1B
  Gene Name: bone morphogenetic protein receptor, type IB
  ENST ID: ENST00000506363
  CDS Start-End: 357-731
gtctgagcagctgagaactttgccggagtattaccacggtgttcagtaacacagacctgtgccatgagcaagtaaagcactgagcaagtgtcagggtcaatatttatagaccactacgtagctgccttgcatagagagaaaacgggagagtaacatgcacacagagggcaaggaaagaaagactgcagtggagggaatgttaatttccaattttttctgaaaatgtattctttctaactgtcaggttcagacttctgctgattcataaccatttggctctgagctatgacaagagaggaaacaaaaagttaaacaagcaagcctgccataagtgagaagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccac

SEQ ID NO: 111786 - DNA, 1764 bp, Homo sapiens
  Payload ID: 1902
  Gene Symbol: BMPR1B
  Gene Name: bone morphogenetic protein receptor, type IB
  Uniprot ID: O00238
  ENST ID: ENST00000509540
  CDS Start-End: 112-1620
attgactgctctgctgctgcaatgggttggctggaagaactaaactggcagcttcacattttcttgctcattcttctctctatgcacacaagggcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctca

SEQ ID NO: 111787 - DNA, 567 bp, Homo sapiens
  Payload ID: 1902
  Gene Symbol: BMPR1B
  Gene Name: bone morphogenetic protein receptor, type IB
  ENST ID: ENST00000502683
  CDS Start-End: 212-556
agctgagctgtattaggcaaccacagtctgggctgcatttcttaactgctgaataacatatcacaggtgcaggattagtgctgcctacggtgctgggctttttagtggaaacccctagcaattctgtgcctcctcctcatgtctctcatcctagggagcctggcaaccatatatcaagcgtacagaaatcaaaacaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggtaaggacactcccattcctcatcaaagaagatcaattgaatgctgcacagaaaggaacgaatgtaataaagacctacaccctacactgcctccattgaaaaacagaggt

SEQ ID NO: 111788 - DNA, 1679 bp, Homo sapiens
  Payload ID: 1902
  Gene Symbol: BMPR1B
  Gene Name: bone morphogenetic protein receptor, type IB
  Uniprot ID: O00238
  ENST ID: ENST00000512312
  CDS Start-End: 171-1679
gctaatgaggagggctgcctgctgggtaagaatgttgttggtggcagagccgttttgtgtactgctgttgagaatgccgggtacattcacaagacgtttcctgcgtgtggtaggaacagctctcaagcaccaatttcatattgtgtcctatcacaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctga

SEQ ID NO: 111789 - DNA, 5567 bp, Homo sapiens
  Payload ID: 1902
  Gene Symbol: BMPR1B
  Gene Name: bone morphogenetic protein receptor, type IB
  Uniprot ID: O00238
  ENST ID: ENST00000515059
  CDS Start-End: 284-1792
gcagccgggcgcggggcgcggagtcggcggggcctcgcgggacgccgggcagtgcggagaccgcggcgctgaggacgcgggagccgggagcgcagccgcggggtggagttcagcctactctttcttagatgtgaaaggaaaggaagatcatttcatgccttgttgataaaggttcagacttctgctgattcataaccatttggctctgagctatgacaagagaggaaacaaaaagttaaacaagcaagcctgccataagtgagaagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccatgtctgtttgtaggacggagaaaccgcttgggtaacttgttcaagatatgatgcatgttgctttctaagaaagccctgtattttgtgattgcctttttttttttttaagatgctttcattttgccaaaataaaacagataatgtggatggtttaagggttatagtattatagtttaaataataacaacaaaattcttcccaggaactctgctggaaggtaaattaaaatacttgtttttccattggtaaaatattgttgcactctgtgaaccaaaagacagtctaagttggaggacatagaacggaactcatcttaaacatactccccaccccgtcttggcctcctcagaccactttggccatccctgcatttggggccgctatggtaatgtgaatgcactgggtacaaacaccgcctgtctaggaccacatttggaattcctgcaggtggccttttgcagcttcaggcaatatggaacaaatgaaggtttatgtgactctaatagaagtaattgttgataggtgttcttcagatccacttctgtttctgattgagttaggcatctctttcatggtaaaacccttttcattaaacacaaagaaagcttttttttttttttttttttttttttttttttaatgtgcagaggattgacctgtgcatgcttttgatctctcattcaaaggatcaatattaaataaaattgtcatgagctgtgttgaagacagggtgctttcaaatagaggtaatttgctcttgtgttgtaagaggaacatgtcaacaaagataggaaatgagggtgatcgtgcagatggcttgtatcttatatatgcaaaggagccaatctcagaagcacaaagaaaaaagtgtgcataccttattttgtacagataaagatgatgtctttttgttattgtctgtctgttttgtatgtgtctgagataagggatagagaggaaacatccgtcaggctaatttaactacattttattttaaaaatagagaaacataacctctagatgggacagcagaggacagttagtagaggccacaaactgttatgggctgctgtgttttgttctaaaatcaatatggttggagcatgtatatcttaggtgatcatttcacatcttaggaatgcctactcattttattttattctagtgatgctcaattcactatttaatttattatattttctcttctgtggcacttatacaaaatatctcttcacctacttagttctacagggttttaactttggagcaacatgaataaaatcatcgagaaggccaatattgtttagcaacatgaatacaatacagtttaaagttgtacacatcctgctcaactttattcatatacatttcctttctgtggttttcttttgcttcttagaaattctgttagtggttagtaaagaatttgaaagtactttctccttgctgtttttttttttttttaagacattcctcccagaatactccagggggcagtgttttataacacattttccccactgggtgattgaaggatggaggatttttgaaaatttgacagctacatgaaacatgagaaaacattttcctcacttctgaagtcggtttgcagctggtaacttgttcatccagaaaacattctaaagcaatgagactttgtgagctgtgcttacagtttgggagaatcatgaagattctttctatattttgcatttacttcccagtgcttcatagctgcattttgtttgtaactaagacagaagaatttcgtaatccttgaaattgaaaaaaaaaaaattgtgtttttaaagagtgaaaacagttagaaaacaagtagaactgtaatcagaacgctgcttcaattgatattaaaaataacctcaataataatgtaaaggttcctttctcttgtgtcagttatattcttagggatagcctagaaggaatatatggttagaactaagtgtgactaatcatctgagccttgaagagaaacttcagtgcctctaaacagatcatctacaaaacaacaggtaaacatttatgccagttaagtgggtcatgtttttgtttcttgggtttttcctaaatttaagtgaggttgggcttaccttgtagataaaattatgttttctttttggtaaatacttgaacgtggataacgtcaaatcagaatattttgtgaggaggtgatgatttgaaattaagctagatttctagggaggtgttggttccaatgaaggatgggaagaaattaaaatagtcttcaaacttcttccttattatatttggttgctttggaaaagattggtcctatcctcaatctaatttattcactattaatattttaaaaacattcctgagatacttaaaaagacccacttagcgattatagttgctcaatgaaacaagaatttatttatgcatagatttttctctgtatcttaccaaaatccactttacttagataacactaaattgttcttaaagactactcatttcccaataatcctttatgatttcaaaatttctagtggctcagaagtgaattttattttatttgtctttcacttgaataaatgagaacccagaaattaataatgttgtttattgcttactgtcaggactatttcaaagactaagaagagtttcttctaacccctccctctcaaaggaatcctaaattattagttgttagataagttttgtatgctaagatattcaggtttatagtttatgtatgtgtgtatatatataaatatatatgtatatataaatattatgttcagtttggagtctggcacaactccattatgtggattagagagtaagatattatggatgataaagtactaaatgaaacataatatttatttataaaagtgtgtagattgttaaatcacaaaaagagtgctatgaccattatgtatgaggaaacaggcctttgacctcctggaaagcactgctcaaaagtcattagtgcccatttttgaattccccaaacagaaagcttcttagaaaacatgctgagattttatttacagggaattctttgacacatttcaattggtgtgtagtcaagtatagcaagtacttaataatgactgaatttcatgttcctacagtcatacatattcattagaagttttatgttgttggtctgatctgattcttctttgtttgtgggtggaacggcactgagagaagtatagttttttaaacttgaacatgttcagtagttacattgccttagaaaacccagacacatagcagtggaaatgaaagaaatggcatcagaagtgacttaatttagcaattgtgattcctcttgtaaaacaaaacaaaaaaacaatgccatattttttggagaaaagttggcaatataggggtttcgttgtctgtttcacaagaagactcatttgttcttttgggggaaccagtgccttacagattttgtatatactgtaattattcaggactagggaacaaacaattgtattgtatttgttacagattgtatatggctttgttttaacattcccctaaataaaatggcttcattctccccttggaaaaaaa

SEQ ID NO: 111790 - DNA, 9683 bp, Homo sapiens
  Payload ID: 1903
  Gene Symbol: BMPR2
  Gene Name: bone morphogenetic protein receptor, type II (serine/threonine kinase)
  Uniprot ID: Q13873
  ENST ID: ENST00000374574
  CDS Start-End: 42-1634
atttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgtaggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgttttgtgttttattggcccttttctttattcagccccttaatctattttcagtcttctggcacgtaatttttttcacagttattattcttctattaacaaattatttttatctttcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagtttttcttagtaaactcctgaaaaagtaggaaaggtggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatctatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgacaata

SEQ ID NO: 111791 - DNA, 11461 bp, Homo sapiens
  Payload ID: 1903
  Gene Symbol: BMPR2
  Gene Name: bone morphogenetic protein receptor, type II (serine/threonine kinase)
  Uniprot ID: Q13873
  ENST ID: ENST00000374580
  CDS Start-End: 540-3656
ggaagcaccgaagcgaaacttaaggaatcctgccttcccggagccgcgggcgatgcgactagggctgccgggcgccgccgccgcccgtccggcttcgtccttcccggcagtcgggaactagttctgaccctcgccccccgaccccggatcgaatccccgccctccgcaccctggatatgttttctcccagacctggatatttttttgatatcgtgaaactacgagggaaataatttgggggatttcttcttggctccctgctttccccacagacatgccttccgtttggagggccgcggcaccccgtccgaggcgaaggaacccccccagccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagataggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgttttgtgttttattggcccttttctttattcagccccttaatctattttcagtcttctggcacgtaatttttttcacagttattattcttctattaacaaattatttttatctttcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagtttttcttagtaaactcctgaaaaagtaggaaaggtggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatctatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgacaata

SEQ ID NO: 111792 - DNA, 3202 bp, Homo sapiens
  Payload ID: 1904
  Gene Symbol: BRINP1
  Gene Name: bone morphogenetic protein/retinoic acid inducible neural-specific 1
  Uniprot ID: O60477
  ENST ID: ENST00000265922
  CDS Start-End: 463-2748
ggagaccgcggcgcacttggacttccctctccattcgccagccgcctcgctcccggaccccacggctgcaaactgatctggcgcgcggggaggaggagagcgcaggcgagcgaacccgcgagagagggagagagcgagcgagcaacagcgagagcgagagcgagagagccgggaggcagagggagtagtgaccgccttccggagccgggattcatgcctgtcctcgggaccagcgaaggggactttacggctgagtatgagccaggctgctaggagccaggtacccccacgcctgcagtccccgcgccgtgcccggaatgcgagctgcacgcagggctctcccaagttcccaccgagccgaataaaaagcgtcctcccgcagctctccgccaaagacggacattgactccaggactccacagaatggagcaagaatgagaggaaaaaggccggcagaaaagcatgaactggaggtttgttgagctcctctacttcctgtttatatggggccgtatctcagtgcagccctcccaccaggaaccagctgggacagaccaacatgtctccaaggaatttgattggctcatttcagacagggggcctttccaccactccaggagctacctatcctttgtggaaagacaccgtcaaggatttacaaccagatataaaatatacagggagtttgcccgttggaaggtgaggaacacagccatcgagaggagagatctggtccgccatccagtgcccctcatgccggagtttcaaaggagcatccgcctgcttggcaggagacctaccactcagcagttcatcgataccatcatcaaaaagtacggcacccacctgctcatctcagccacattgggaggggaggaggctttgaccatgtatatggacaaaagtcgcctcgacaggaagtcagggaatgccactcaaagtgttgaagctctgcaccagctcgcatcatcctactttgttgaccgtgatggtaccatgaggaggcttcatgagatccagatatcaactggagcaatcaaggtcacagagacacgcactgggcctctgggctgtaacagctatgacaatctggactctgtgagttccgtccttctgcaaagcacggagagcaaactgcaccttcaaggtcttcagataatctttcctcagtatctgcaagagaagtttgtccagtcggccttgagctatatcatgtgcaatggggagggggagtacctgtgccagaacagccagtgtcgctgccaatgtgccgaggagtttccgcagtgcaactgccccatcacggacatccagatcatggagtacacgctggccaacatggccaagtcttgggccgaagcttataaggacctggagaattcagatgagtttaaatcatttatgaagcgcctccccagcaaccacttcctgaccatcggaagcatccatcagcactggggcaatgactgggacctgcagaaccgctacaagctcctgcagagtgccacggaggcacagagacaaaagatccaacgcactgcccgcaagcttttcggcctcagtgtacgctgtcgccacaatcccaaccaccagctgcctagagagaggacaattcagcagtggcttgcaagggtccagtcactcctctactgtaatgagaatgggttttggggaaccttcctggagagccagcggagctgcgtgtgccacggcagcaccacgctgtgccagcgccccatcccctgcgtgataggcgggaacaacagctgcgccatgtgcagcctggccaacatctccctctgcggctcctgcaacaagggctacaagctgtatcgaggccgctgtgaaccacagaacgtggactcggagcggagcgagcagttcatcagctttgagactgacctggacttccaggacctggagctgaagtacctgctgcagaagatggactcacgcctctacgtccacaccaccttcatcagcaacgagatccgcctcgacaccttctttgaccctcggtggcgcaagcgcatgtccctcactctcaagagcaacaagaaccgcatggacttcatccacatggtgatcggcatgtccatgcgcatctgccagatgcgcaacagcagcctggaccccatgttctttgtctatgtcaacccctttagcgggagccattcggagggctggaacatgcccttcggggaatttggctacccacgctgggagaagatccgtctccaaaacagccagtgctacaactggactcttttgctgggcaatcggtggaaaacatttttcgagacggtccacatctacctacgtagtcggactcggctacctaccctactgcgaaatgagactggccagggccccgtggacctgtcggatccctccaagaggcagttctacatcaagatctcagacgtgcaggtgtttgggtatagcctgaggttcaacgccgacctcctgcgcagtgcagtgcagcaggtcaaccagtcctacacacagggcggccagttctattcctcttcgtcagtgatgctcctcttgttggatattcgggaccgaattaatcgcctggcccctcctgtggccccggggaaaccccagctggacttgttctcctgtatgctgaaacaccgcctgaaactgaccaacagcgagatcatcagggtgaaccacgccttggacctgtacaacacggagatcctcaaacagtcggaccagatgacagccaaactctgctaacccgggactccttgccatggacttttcctgttgttgtacacacacaacagaacaaaatgaagcaaaacaaaacaaaaaaacccacaaaaatttgtaaaatgtaattaatattcaaagaaaaggaggaaaatcttcatttgttggaaatgaaaacgttctagcaactgtataaaagcgttgggcatgtttgttatttctatactcactctgtcatgaagaagggtctcagccttttgtggagcattgagggagttgcttcttaggcctcaggtgctgtattgggggagaagggagaaagcatatgcaatgaattgtaaagatctctgctgtgcaggtgctaagattaaacactaaaaagaaagagagatatatgtaatgtacaactgacactgccatttttcctttttggaggaaatggacatagataaagaagatatttcttcggttaagattt

SEQ ID NO: 111793 - DNA, 1641 bp, Homo sapiens
  Payload ID: 1904
  Gene Symbol: BRINP1
  Gene Name: bone morphogenetic protein/retinoic acid inducible neural-specific 1
  Uniprot ID: O60477
  ENST ID: ENST00000373964
  CDS Start-End: 421-1383
cgcctcgctcccggaccccacggctgcaaactgatctggcgcgcggggaggaggagagcgcaggcgagcgaacccgcgagagagggagagagcgagcgagcaacagcgagagcgagagcgagagagccgggaggcagagggagtagtgaccgccttccggagccgggattcatgcctgtcctcgggaccagcgaaggggactttacggctgagtatgagccaggctgctaggagccaggtacccccacgcctgcagtccccgcgccgtgcccggaatgcgagctgcacgcagggctctcccaagttcccaccgagccgaataaaaagcgtcctcccgcagctctccgccaaagacggacattgactccaggactccacagaatggagcaagaatgagaggaaaaaggccggcagaaaagcatgaactggaggtttgttgagctcctctacttcctgtttatatggggccgtatctcagtgcagccctcccaccaggaaccagctgggacagaccaacatgtctccaaggaatttgattggctcatttcagacagggggcctttccaccactccaggagctacctatcctttgtggaaagacaccgtcaaggatttacaaccagatataaaatatacagggagtttgcccgttggaaggtgaggaacacagccatcgagaggagagatctggtccgccatccagtgcccctcatgccggagtttcaaaggagcatccgcctgcttggcaggagacctaccactcagcagttcatcgataccatcatcaaaaagtacggcacccacctgctcatctcagccacattgggaggggaggaggctttgaccatgtatatggacaaaagtcgcctcgacaggaagtcagggaatgccactcaaagtgttgaagctctgcaccagctcgcatcatcctactttgttgaccgtgatggtaccatgaggaggcttcatgagatccagatatcaactggagcaatcaaggtcacagagacacgcactgggcctctgggctgtaacagctatgacaatctggactctgtgagttccgtccttctgcaaagcacggagagcaaactgcaccttcaaggtcttcagataatctttcctcagtatctgcaagagaagtttgtccagtcggccttgagctatatcatgtgcaatggggagggggagtacctgtgccagaacagccagtgtcgctgccaatgtgccgaggagtttccgcagtgcaactgccccatcacggacatccagatcatggagtacacgctggccaacatggccaagtcttgggccgaagcttataaggacctggagaattcaggtagagagtctcactcagtgccactgcatgagtggccttgagccaagtctgaaagggagctaatctaactggaattaggactgctgcaagggaaagttcagtgaccctgaccctttcactttggagtgtccagatgcaagtataatagctgtcacagagcaggcactcaataaatctcaactgaataaaattaatgaatagcataatccagtttgtggtcatatgatgtattgtttctgtcgtacccagaagacagaaagaataaatctgcataggaagcctctggagagggaagagtc

SEQ ID NO: 111794 - DNA, 3558 bp, Homo sapiens
  Payload ID: 1905
  Gene Symbol: BRINP2
  Gene Name: bone morphogenetic protein/retinoic acid inducible neural-specific 2
  Uniprot ID: Q9C0B6
  ENST ID: ENST00000361539
  CDS Start-End: 313-2664
agcggggagcaagagaatttgaaaagagacatccgctccctctcacacgctgagggggaggcattcgcgtttccccaaatgagaaagaaccacaagaaatcatgaagtaaaaactttggaaagctgccactggagatgttgcacaaaaacctggaatcttttaggagtctcctcccagtcgttgaaggtttggggagcagctgatacagcaaggagggctcttgcaaggattcaagctccgagccctggaggagcagcacggagcgggagagcgtggcgagagaatgaagaaaccaatcgcccgggagaagcatgaggtggcagtgtggcactcggtttagagggcttcggccggcggtggccccatggacagccctgctggcactgggcctgcctggctgggtgttggctgtctcagccacggcggctgctgtggtccccgagcagcatgcctccgtagctggccagcatcccctggactggctgctcacagaccggggccccttccaccgcgctcaggagtatgctgacttcatggagcggtaccgccagggtttcaccaccaggtacaggatttatagggagtttgcccgttggaaggtgaacaacttggctctggaaaggaaggacttcttcagtttgccattgcctcttgccccagagtttatccggaacattcgcctccttggaaggagacccaatctgcaacaggttacagaaaatctgattaaaaagtacggcactcatttcttactttctgccacccttggaggagaagagtccctgaccatttttgtggacaagcagaaactgggaagaaagacagagacaacaggaggtgcctctataatcgggggcagtgggaacagcacagctgtgtccctggagaccctgcaccagctggccgcctcctacttcatcgacagagagagcacgctgcgacggctgcaccatatccagatagccacgggggccatcaaggtcaccgagaccaggaccggtcctctgggctgcagcaactatgacaatctggactcagtcagttctgtcttggtacagagtccagagaacaaagtacagttacttggccttcaggtgctgctgcctgagtatctgcgtgagcgctttgtagctgcagcactcagctacatcacatgcagctctgagggtgagctcgtctgcaaggagaatgactgctggtgcaagtgcagccccaccttccctgaatgcaactgccctgatgctgacatccaggccatggaggacagcctgctgcagatccaggactcctgggccactcacaaccggcagtttgaagagtcagaagagttccaggccctgctgaaaaggctgcccgatgaccggttcctgaactccacagctatctcccagttctgggccatggacaccagccttcagcaccgctaccagcagctgggagctggcttgaaagtgctgttcaaaaagacccatcggatcctacgccggctcttcaacctctgcaagcgctgccatcgccagcctcgcttccgcctgcccaaggagaggtccttgtcctactggtggaaccgaatccagtccctcctctactgtggggaaagcacctttcctggcactttcctggaacagagccacagctgcacctgcccctatgaccaatcttcctgccagggccccatcccatgtgccttgggcgaagggcccgcgtgtgcccactgtgctccagacaatagcacacgctgtgggagctgcaacccgggctatgtgctggcccaggggctgtgccggccagaggtggccgagtccctggaaaactttcttgggctggagacagacttgcaggacctggagctaaagtacctgctgcagaagcaggatagccgcattgaggtacactccatcttcatcagcaatgacatgcggctgggcagctggtttgacccttcctggaggaagcgcatgctgctcaccctgaagagcaacaagtacaagcctgggctggtgcacgtgatgttggccttgtccttgcagatctgtctcaccaagaacagcaccctggagcctgtcatggccatctacgtcaacccctttgggggcagccactctgagagctggttcatgcctgtgaatgagggcagctttcctgactgggaaaggactaacgtggatgcagctgcccagtgccaaaactggactatcaccttggggaataggtggaagactttctttgagacagttcatgtttacctacggagccgaatcaagtccctggatgacagctccaatgagacaatctactatgagcccctggagatgactgatccctctaagaatttgggttacatgaaaattaacaccttgcaggtctttggctacagcctgccctttgacccagatgctatccgggacttaattctccagttggactacccatatactcaaggttcccaggactctgcactcttgcagctcattgagctcagggaccgggtgaaccagctttctccacctggcaaagtccgacttgaccttttctcctgcttgctccggcatcggcttaagctggccaacaatgaggtgggcaggatccagtcctccctgagggctttcaattctaagctgccaaaccctgtggaatatgagaccggcaaactctgtagctaatgggcggcccacttcagcactgggcaaggaggggatccatgaatctggggtacaaagataatctaagccctcaccttagtgccaacagggtgtgctcccacgagactttcagcatccagtagatgggacctcgaggctcgagctgaagcaggcgagagagaaacagctactgcgtgcgtgcgcgcacgcatacacacacacacacacacactggcacagggaggctacaactaagcagcctcagatctgtaaagttgattggtgctttctaaaatgaatgcaattgaaagaaaggagccaaggaagagattaagaaaaagaaccagctgaaccatgaaacaaacaaaaatcctaaaagtgattcttgtcattcaagaaagcaagaggggacaacaatgggaggggtcggagctcttccttcccctctgtggagtcacttttgtattctttttaaccagatttcttaaaatgttgttgttttgtgaatcctgacattggttcttacttttgtatgctgcctcctctgtgccctcccagacgctgactgggaaacacaagaagtacaaccaacaggaaccagcgccaagggcaggcagcggcctccttgctcccctcccttactcctccctctgctgcctcctccccccaccaagtttcagggccctggattgttcccagttcccattgtggtcccttcagagctcctttccaacagcatctctctgtcgaagaaagaagctctgtcaagttagagagagacaatgtgtaggaaatgttcttttttaaaaaaaaataacaaaaacaaaacaaaactatttattttgtgattgttttccttgttaatctgctccaaccacctgaacatctaagtaaacatttatctggtttaatata

SEQ ID NO: 111795 - DNA, 3142 bp, Homo sapiens
  Payload ID: 1906
  Gene Symbol: BRINP3
  Gene Name: bone morphogenetic protein/retinoic acid inducible neural-specific 3
  Uniprot ID: Q76B58
  ENST ID: ENST00000367462
  CDS Start-End: 486-2786
atgactacagccttgctcactagttctctctttatctcgttgtcttcaacacatccttttacttctctttgcagatttatctgtattccacctcctgttctctggggttacacagcttctgcctttccccactgtatggggatgtgcagcctgtaaattttcactttgcttaaggatcaccacgaatcaccccccaccattccccacccccccatataaagcattttcacattctgctttcttgccttgggggttcgtggctctctgtgtaactggtttttacttggttacatgccaccaggaactgctgattattttaaagtcctactaccctgcagctcactactttaccttgatttggaagatcatggaatatctatttgaatcctggatgtatttttctcacagtcttcttgcttcctgaaatttcctctggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacagggagtttggccgctggaaagtaaataaccttgcagttgagagaagaaatttccttggctctcctctgcctcttgcccctgaattcttccgcaacataagacttttgggacgtcgacctacccttcagcaaatcacagaaaaccttatcaagaaatatgggacacatttcttgctatctgctactctgggaggagaggagtcactcacaatttttgtggacaagcggaagttgagcaaacgagctgaaggaagtgattccaccaccaatagctcttcggtcactctggagacgctacatcagctagccgcttcttatttcattgacagggacagcacccttcggagacttcaccacattcaaattgcatccactgccataaaggtaacagaaacacggactggtcctcttggctgcagtaactatgacaacctagattctgtcagttctgttctggttcagagtcctgagaataagattcagttgcaagggcttcaagtacttctcccagactatcttcaggaacgttttgtacaagcagctttgagctacattgcttgcaattcagagggagagtttatctgcaaggaaaatgactgctggtgtcactgtggtcccaaatttccagaatgcaactgcccctccatggacattcaagccatggaagagaatcttcttcgaataactgaaacctggaaagcttacaacagtgactttgaggaatcagatgaattcaagttatttatgaaaaggctacctatgaattatttcctcaacacatctactataatgcatttgtggacaatggattctaattttcagcgccgttatgaacaactggagaacagcatgaaacaacttttcctaaaggcgcagaaaattgtacacaagctttttagccttagcaagaggtgtcataaacaacccctcatcagcctgccaagacaaagaacctcaacctactggcttactcgcatccagtcttttctctactgcaatgagaacggcctcctaggcagcttttcagaagagacgcactcgtgcacgtgtccgaatgaccaggtggtctgcaccgcgttcctgccctgcacagtgggagacgcctctgcctgcctgacatgcgcaccagacaaccgcacccgctgcggcacctgcaacaccggctacatgctcagccaggggctctgcaagcctgaagtcgccgagtccaccgatcactatattggctttgaaactgacctgcaagatctcgagatgaaatatctgctgcagaaaacggacagacgaatagaagtccatgccatttttatcagcaatgacatgcgcctcaatagctggtttgatccctcctggcgtaagcggatgctcctcaccttgaagagcaataagtacaagtcaagtctggtccatatgattttgggtctctctttacagatttgcttaactaaaaacagcaccttggagccagtgttggctgtttatgtcaatcccttcggaggcagccactctgagagctggtttatgcctgtgaatgaaaacagctttccagactgggagcggactaagttggacctacccctgcagtgttataactggacattaactctggggaacaaatggaagacattttttgagacagtacacatctacctgagaagtcgcatcaagtccaatggtcccaatggtaatgagagcatttactatgaacctctggagtttattgacccttcccggaacctgggctatatgaaaatcaataacattcaagtgtttggctacagcatgcactttgaccctgaagcaattcgggacctgattttgcagctggactacccctatactcagggatcccaggattcagcacttttgcaactactagagatcagagaccgtgtaaataaactctccccacctggtcagcgtcgtctagatcttttctcttgcttgcttcgtcatagactcaagctgtctactagtgaggtggtgaggatccaatctgctctgcaggcgtttaatgccaaattgccaaacacaatggattatgacacgaccaaattatgtagttaaccataaatgtcaagcacaacccaaaatcttgaaggagtttttacagtgcttttgtggaacagtttatgtttggaagagtaaatttaaattgtcttttcaatatctgtcttatatcagtcaataacattggatggcaatttacacacatgaacttgctgacaatgaatatattatacagcagttttggtttatgaatgacataaatactgacaccagtctagaagacattctactttttacaataaatttcatttgtaattttatatgttccgtggcaatgcttttgtgcattacatcctctagagggaacataaaaagataccaataaaattttgtagctgaacagttattaaaaa

SEQ ID NO: 111796 - DNA, 528 bp, Homo sapiens
  Payload ID: 1906
  Gene Symbol: BRINP3
  Gene Name: bone morphogenetic protein/retinoic acid inducible neural-specific 3
  ENST ID: ENST00000445957
  CDS Start-End: 445-528
ctgatggctgttctcctagtccccaagagttgaaccggagaggcttttactttgcaccaggtcgagaacgtgatcagccctttagagaaggaacctccttgtaacaggaattctgctgggaaacgccgtgtaggcactacctccgaagataagatgcatgtttggagctgtgtaaaatgcccactggctgtttgaaagaaggaaaaggtgactagggttgcaaattaaccttagtatcacttaaaaatattctatctagtcaaatgtacgtaagcaaagaagagagcaccaggatataaaactgccacagcagcttggaagacagatgattcagattttggggactttcttttgcgtgttacatagatttgtttgtcatcatgcagttaagcaggtgttgagggaaagctgagagaatgaaggctctaaatccccagtggaagcatgatatggcgaagcagagctggtgctgaattgttctctctgatggctctatgggagtggatagcactgagtcttcattgctgg

SEQ ID NO: 111797 - DNA, 729 bp, Homo sapiens
  Payload ID: 1906
  Gene Symbol: BRINP3
  Gene Name: bone morphogenetic protein/retinoic acid inducible neural-specific 3
  ENST ID: ENST00000631494
  CDS Start-End: 256-729
ccggtcgtcctgcctgacaagccagtgccatcagagtccgtgacttcatttgaagaaaggagggcttcatataattcaattcaaacattctctttggaggactgctgttgttgcgcaagggtggagggaggaaaaaaaaaagaaaaagaaaaaaaaaactttcagtacagtcagatccagtaaggaacagacagtcagtatttaggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacagggagtttggccgctggaaagtaaataaccttgcagttgagagaagaaatttccttggctctcctctgcctcttgcccctgaattcttccgcaacataagacttttgggacgtcgacctacccttcagcaaatcacagaaaaccttatcaagaaatatgggacacatttcttgctatctgctactctgggaggagaggagtcactcacaatttttgtggacaagcggaagttgagcaaa

SEQ ID NO: 111798 - DNA, 642 bp, Homo sapiens
  Payload ID: 1907
  Gene Symbol: BORA
  Gene Name: bora, aurora kinase A activator
  ENST ID: ENST00000377814
  CDS Start-End: 1-642
aaagagtctatgcctgtcgtggaagctggcctggcccccggagctccctggagtcggtactgggggcttcgttttgtacgcaccgactccagggaaatttagatggtctattgatcaactagctgtaataaatcctgtagaaatagacccagaagatattcatcgtcaagctttatacttaagtcattctcgaatagataaagatgtggaagacaaaagacaaaaagccattgaagagtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtg

SEQ ID NO: 111799 - DNA, 1673 bp, Homo sapiens
  Payload ID: 1907
  Gene Symbol: BORA
  Gene Name: bora, aurora kinase A activator
  Uniprot ID: Q6PGQ7
  ENST ID: ENST00000377815
  CDS Start-End: 204-1673
aaagagtctatgcctgtcgtggaagctggcctggcccccggagctccctggagtcggtactgggggcttcgttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaaatagataaagatgtggaagacaaaagacaaaaagccattgaagagtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatag

SEQ ID NO: 111800 - DNA, 2936 bp, Homo sapiens
  Payload ID: 1907
  Gene Symbol: BORA
  Gene Name: bora, aurora kinase A activator
  ENST ID: ENST00000390667
  CDS Start-End: 95-1954
gaatttggagccacgttcctctgcgcggaacgtggagcgaggagttgccattcgaatttcctacgcggcctccgtgcgattggctggttcgcggatggcgggacgacacgattggctagtcgctcacaagccccgtgccctggttggcccaagacagcgcggaagcggggagttaaagagtctatgcctgtcgtggaagctggcctggcccccggagctccctggagtcggtactgggggcttcgttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaactccagggaaatttagatggtctattgatcaactagctgtaataaatcctgtagaaatagacccagaagatattcatcgtcaagctttatacttaagtcattctcgaatagataaagatgtggaagacaaaagacaaaaagccattgaagagtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatagaatgcctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatacttacattgagtgatgtgtttaacaacaaattgtgacagagctgagtgctcctatcttacagggtcaatgaactacttattaagccttactggtagcactgaatttagcagttctgagaacatgtgaaactatgttaaaactgaaggcactatatatttttacataaaagcttgaacatacagatgaattataacctatgtgaagaaatcttagatataaaactaacttttcaaagatacaaaagaaattaaacaggtttcctgaaattttagttcttggtctgttcacctctgtggggaaaattcttagttccagtgataactgttctagttactacttttaagtatgtaaatactagaaaggtagtactagtgacatcatcacgtgtattgttatctatggggcaaatgtgtggtgcccagaataaaatatacctcatgcctagggtagggacatcctttccagctcaaacgtgggtagggatgtgggagaataagaatgtgggagaaccaagagaaaaagtggggctgggagagtggagttcccgtagggcataggcctgtgaagtaacactggggcagatatgtatgttatatacaactatttttttaaaaaacttatatccatgttgggagtagatgggtatataacagtttggaaatactatctttggagaatgtatttttgtatttataaatcaacttttaaaaactgtctcattcaaaagggaataaagacctgtgttatcaatg

SEQ ID NO: 111801 - DNA, 3034 bp, Homo sapiens
  Payload ID: 1907
  Gene Symbol: BORA
  Gene Name: bora, aurora kinase A activator
  ENST ID: ENST00000613797
  CDS Start-End: 148-2052
agcgcggaagcggggagttaaagagtctatgcctgtcgtggaagctggcctggcccccggagctccctggagtcggtactgggggcttcgttttgtacgcaccggtaggtacgctctttgtggtccctggcctttcctcctgtctgaatggagaggtttcttttcccagctcctgacttgcctgcccgctcgcccctggtgaatgggagcagtcagggagtaggtgtggaagagaggggcaccagaaagagtggccacgtagggttgggggcgacgcctccttcgcactccatccagggaagccggctgcatctcaaccttccagaagtagactcttttccaccccaccccgccaagttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaactccagggaaatttagatggtctattgatcaactagctgtaataaatcctgtagaaatagacccagaagatattcatcgtcaagctttatacttaagtcattctcgaatagataaagatgtggaagacaaaagacaaaaagccattgaagagtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatagaatgcctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatacttacattgagtgatgtgtttaacaacaaattgtgacagagctgagtgctcctatcttacagggtcaatgaactacttattaagccttactggtagcactgaatttagcagttctgagaacatgtgaaactatgttaaaactgaaggcactatatatttttacataaaagcttgaacatacagatgaattataacctatgtgaagaaatcttagatataaaactaacttttcaaagatacaaaagaaattaaacaggtttcctgaaattttagttcttggtctgttcacctctgtggggaaaattcttagttccagtgataactgttctagttactacttttaagtatgtaaatactagaaaggtagtactagtgacatcatcacgtgtattgttatctatggggcaaatgtgtggtgcccagaataaaatatacctcatgcctagggtagggacatcctttccagctcaaacgtgggtagggatgtgggagaataagaatgtgggagaaccaagagaaaaagtggggctgggagagtggagttcccgtagggcataggcctgtgaagtaacactggggcagatatgtatgttatatacaactatttttttaaaaaacttatatccatgttgggagtagatgggtatataacagtttggaaatactatctttggagaatgtatttttgtatttataaatcaacttttaaaaactgtctcattcaaaagggaataaagacctgtgttatcaatg

SEQ ID NO: 111802 - DNA, 533 bp, Homo sapiens
  Payload ID: 1907
  Gene Symbol: BORA
  Gene Name: bora, aurora kinase A activator
  ENST ID: ENST00000618209
  CDS Start-End: 92-436
tttggagccacgttcctctgcgcggaacgtggagcgaggagttgccattcgaatttcctacgcggcctccgtgcgattggctggttcgcggatggcgggacgacacgattggctagtcgctcacaagccccgtgccctggttggcccaagacagcgcggaagcggggagttaaagagtctatgcctgtcgtggaagctggcctggcccccggagctccctggagtcggtactgggggcttcgttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccagcactaacataaatagtgactctccagttggaaaaaagctgaccattcattctgagaaaagcgatgctgcttgtcagacattgctgtctcttcctgtggattttaattt

SEQ ID NO: 111803 - DNA, 2670 bp, Homo sapiens
  Payload ID: 1908
  Gene Symbol: BORCS7-ASMT
  Gene Name: BORCS7-ASMT readthrough (NMD candidate)
  ENST ID: ENST00000299353
  CDS Start-End: 16-336
cgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacattggctgcacttcgtgacgctgagatacagaaggacgtgcagacctactacgggcaggtgctgaagagatcggcagacctccagaccaacggctgtgtcaccacagccaggccggtccccaagcacatccgggaagccttgcaaaatgtacacgaagaagtagccctaagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtggaagtggctgaaaagtatcttgactatcacatggaaaaatatggcttccaggcatctaatgtgacttttattcatggctacattgagaagttgggagaggctggaatcaagaatgagagccatgatattgttgtatcaaactgtgttattaaccttgtgcctgataaacaacaagtgcttcaggaggcatatcgggtgctgaagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatggggccgggcacagtggctcatgcctataatcccagcactttgggaggccgaggcaggcagatcacctgaggtcaggagtttgataccagcctggccaacatggtgaaatcctgtctctaccaaaaatacaaaaaaaattagctgggcatggtggtgcacacctatagtctcagctactcgggaggctgaggcaggagaattgcttgaacccaggaagtagaggctgcagtgagtaagcatcacgccactgtactccagcctgggcaacagagcaagactctgtctcaaaagcaaaaaaaaaaaaaaaaaaagaaagaaagaaaaagaaaacaacaaatggcagagagccaccatattccaaatcactgaaaaaaataaatgaattatttttatttatttatttatttttttgagatggagtctcggtctgttgcccaggctgaagtgcagtggccccatctcaactcactgcaagctccacctcctgggttcacgccattctcctgcctcagactcccaagtagctgggactacaggcacctaccaccatgcccagctaattttttgtatttttagtagagacggggtttcaccatgttagccaggatggtcttgatctcctgacctcgtgatccgcccgcctcggcctcccaaagtgctgggattacaagcatgagccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataaa

SEQ ID NO: 111804 - DNA, 1492 bp, Homo sapiens
  Payload ID: 1909
  Gene Symbol: BORCS8-MEF2B
  Gene Name: BORCS8-MEF2B readthrough
  ENST ID: ENST00000444486
  CDS Start-End: 268-1365
cggccgcggtcgctatggaggagccggagatgcagctcaaggggaagaaagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccaga

SEQ ID NO: 111805 - DNA, 1406 bp, Homo sapiens
  Payload ID: 1909
  Gene Symbol: BORCS8-MEF2B
  Gene Name: BORCS8-MEF2B readthrough
  ENST ID: ENST00000514819
  CDS Start-End: 148-1296
gttcgctcggccgcggtcgctatggaggagccggagatgcagctcaaggggaagaaagcgccgtgaagaacctggtggacagcagcgtctacttccgcagcgtggagggtctgctcaaacaggccatcagcatccgggaccatatgaatgccagtgcccagggccacagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgt

SEQ ID NO: 111806 - DNA, 1695 bp, Homo sapiens
  Payload ID: 1909
  Gene Symbol: BORCS8-MEF2B
  Gene Name: BORCS8-MEF2B readthrough
  ENST ID: ENST00000354191
  CDS Start-End: 42-401
gcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggacca

SEQ ID NO: 111807 - DNA, 554 bp, Homo sapiens
  Payload ID: 1909
  Gene Symbol: BORCS8-MEF2B
  Gene Name: BORCS8-MEF2B readthrough
  ENST ID: ENST00000602689
  CDS Start-End: 6-365
tcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccaggtgtaacttggacccatttctcttgcgtgaatattgaacatcgaggagcggaattcctgggtcacaggacaaagatcattccactcagcctgggacgatggggaggaaaaaaatccagatctcccgcatcctggaccaaaggaatcg

SEQ ID NO: 111808 - DNA, 1804 bp, Homo sapiens
  Payload ID: 1909
  Gene Symbol: BORCS8-MEF2B
  Gene Name: BORCS8-MEF2B readthrough
  ENST ID: ENST00000602804
  CDS Start-End: 42-401
gcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtgga

SEQ ID NO: 111809 - DNA, 1664 bp, Homo sapiens
  Payload ID: 1909
  Gene Symbol: BORCS8-MEF2B
  Gene Name: BORCS8-MEF2B readthrough
  ENST ID: ENST00000630940
  CDS Start-End: 12-371
ccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggacc

SEQ ID NO: 111810 - DNA, 2742 bp, Homo sapiens
  Payload ID: 1910
  Gene Symbol: BOLL
  Gene Name: boule-like RNA-binding protein
  Uniprot ID: Q8N9W6
  ENST ID: ENST00000282278
  CDS Start-End: 542-1066
agacgccccggctcggagtcccagggccacagccgaaactcgccctcccgcgcccctctccggcttgcagcgcccgcccgcaccgccacctgccacccgaggcgacgcagtccgcttctccccacccgccaggtggcaggttcagggccggggtccgagcctgcttccctgcagctgccacagccaccctcgccgccagggggcgagagtcccaggcaggacaagcagcgctgctgccttggcgtgaaggtggtttcaaactttaggcttcttttccctaccccgcgtctctgaagagcagagaggaagatggaaaccgagtccgggccgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggtttttaatctctaaaatttctacagtagtacaggaaatattcctctttacattcatttgcagttctttcactgacctcctaattttaggtggagggggcagggggagccataaaagttggtattaccctaataaatctatctctttcctcccctgtttcaaccccacatgtattccatgctcagcagcagcagcagaaatagtaggatatagatcacaaaggtttttctggtgagtcaaatagggtgttttcttttgaaactgtaatgaatatgtttgccagtcaaatggcttcatgagaacagtagaaccttatgaatgtatactagcatacaaggatctcaaatacattaattattctcagttttaggaatgtaaatagattaagtcccacaatgaaatttcagaagtttttgttctgtaagtaaaaaattactaaccactgatgttcaagattttcttttaatagcactatccttgagaaccaaaaagtttatgttttgattttcaaatgttaaacaagatgctaaacaaatcctggactgttaataaaaattaattatgtattattggataaggaatttt

SEQ ID NO: 111811 - DNA, 3135 bp, Homo sapiens
  Payload ID: 1910
  Gene Symbol: BOLL
  Gene Name: boule-like RNA-binding protein
  Uniprot ID: Q8N9W6
  ENST ID: ENST00000321801
  CDS Start-End: 572-1459
acaccagtcttcggaagtcgcccgtcaaccggcttcttctacctcagtaaagccttaaggtcacctcaacctctcgaaacccaccagtcccagaggccgactcttctcaagtggaggagaggggaaggcgtgcatggagctttgcctgaccgctcgctctctcctccccagccgtctgagagaaggcgagaggggtcccagaaccgagccctcgctccgcacgccccacgcccgccccgctgtgccgtgcgctctgcccctgagacgccccggctcggagtcccagggccacagccgaaactcgccctcccgcgcccctctccggcttgcagcgcccgcccgcaccgccacctgccacccgaggcgacgcagtccgcttctccccacccgccaggtggcaggttcagggccggggtccgagcctgcttccctgcagctgccacagccaccctcgccgccagggggcgagagtcccaggcaggacaagcagcgctgctgccttggcgtgaaggtggtttcaaactttaggcttcttttccctaccccgcgtctctgaagagcagagaggaagatggaaaccgagtccgggccgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggtttttaatctctaaaatttctacagtagtacaggaaatattcctctttacattcatttgcagttctttcactgacctcctaattttaggtggagggggcagggggagccataaaagttggtattaccctaataaatctatctctttcctcccctgtttcaaccccacatgtattccatgctcagcagcagcagcagaaatagtaggatatagatcacaaaggtttttctggtgagtcaaatagggtgttttcttttgaaactgtaatgaatatgtttgccagtcaaatggcttcatgagaacagtagaaccttatgaatgtatactagcatacaaggatctcaaatacattaattattctcagttttaggaatgtaaatagattaagtcccacaatgaaatttcagaagtttttgttctgtaagtaaaaaattactaaccactgatgttcaagattttcttttaatagcactatccttgagaaccaaaaagtttatgttttgattttcaaatgttaaacaagatgctaaacaaatcctggactgttaataaaaattaattatgtattattggataaggaatttt

SEQ ID NO: 111812 - DNA, 2838 bp, Homo sapiens
  Payload ID: 1910
  Gene Symbol: BOLL
  Gene Name: boule-like RNA-binding protein
  Uniprot ID: Q8N9W6
  ENST ID: ENST00000392296
  CDS Start-End: 311-1162
aatcagggagcgccgcgcgagggtggggaccagctgcgcacgaggccagcggcggggtcgctgccgttgaggcttcccgccactgctgctggcggatttgtggggcaaaatttctcgctggctagccttcttttccctcccgcactttggtggggagggggtggatcctcgtttcggtgcccaagttcacgatgacccgagagaactcgaggaagttgtcgccgcggccatttcccccagtgccgcaacttgctggccttggagggggaggagcgccgaggcagtgactgcgacgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggtttttaatctctaaaatttctacagtagtacaggaaatattcctctttacattcatttgcagttctttcactgacctcctaattttaggtggagggggcagggggagccataaaagttggtattaccctaataaatctatctctttcctcccctgtttcaaccccacatgtattccatgctcagcagcagcagcagaaatagtaggatatagatcacaaaggtttttctggtgagtcaaatagggtgttttcttttgaaactgtaatgaatatgtttgccagtcaaatggcttcatgagaacagtagaaccttatgaatgtatactagcatacaaggatctcaaatacattaattattctcagttttaggaatgtaaatagattaagtcccacaatgaaatttcagaagtttttgttctgtaagtaaaaaattactaaccactgatgttcaagattttcttttaatagcactatccttgagaaccaaaaagtttatgttttgattttcaaatgttaaacaagatgctaaacaaatcctggactgttaataaaaattaattatgtattattggataaggaatttt

SEQ ID NO: 111813 - DNA, 1270 bp, Homo sapiens
  Payload ID: 1910
  Gene Symbol: BOLL
  Gene Name: boule-like RNA-binding protein
  Uniprot ID: Q8N9W6
  ENST ID: ENST00000433157
  CDS Start-End: 398-1249
agatctcgaggttgattctcaaggggaggggccagtgagggcacattgctttggaggagtagtttaataaactctctagtgctggaagttttagcaaacggaggagccttcaaacccggcaacagtccccatctaggtgtttccgtaacacatgcggaattattgctagtggaatttcaggctttctttgttgtttaactcaatgcatcgctaattgtttataatgaacttagatgttgcctccacctgagccttgctattgctaacattaaaatattttgtaggcctggcgcgatggctcccgcctgtaatcccagcactttgggaggccaaggtgggcggatcacgaggtcaggagatcgagaccatcctggccaaaatgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattc

SEQ ID NO: 111814 - DNA, 2987 bp, Homo sapiens
  Payload ID: 1910
  Gene Symbol: BOLL
  Gene Name: boule-like RNA-binding protein
  ENST ID: ENST00000430004
  CDS Start-End: 398-1399
agatctcgaggttgattctcaaggggaggggccagtgagggcacattgctttggaggagtagtttaataaactctctagtgctggaagttttagcaaacggaggagccttcaaacccggcaacagtccccatctaggtgtttccgtaacacatgcggaattattgctagtggaatttcaggctttctttgttgtttaactcaatgcatcgctaattgtttataatgaacttagatgttgcctccacctgagccttgctattgctaacattaaaatattttgtaggcctggcgcgatggctcccgcctgtaatcccagcactttgggaggccaaggtgggcggatcacgaggtcaggagatcgagaccatcctggccaaaatgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccagggaattaaacaatgtcatacaagaagatggatggactctttgcttccttttaccaaatgtgatgaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaatgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggtttttaatctctaaaatttctacagtagtacaggaaatattcctctttacattcatttgcagttctttcactgacctcctaattttaggtggagggggcagggggagccataaaagttggtattaccctaataaatctatctctttcctcccctgtttcaaccccacatgtattccatgctcagcagcagcagcagaaatagtaggatatagatcacaaaggtttttctggtgagtcaaatagggtgttttcttttgaaactgtaatgaatatgtttgccagtcaaatggcttcatgagaacagtagaaccttatgaatgtatactagcatacaaggatctcaaatacattaattattctcagttttaggaatgtaaatagattaagtcccacaatgaaatttcagaagtttttgttctgtaagtaaaaaattactaaccactgatgttcaagattttcttttaatagcactatccttgagaaccaaaaagtttatgttttgattttcaaatgttaaacaagatgctaaacaaatcctggactgttaataaaaattaattatgtattattggataaggaatttt

SEQ ID NO: 111815 - DNA, 1372 bp, Homo sapiens
  Payload ID: 1910
  Gene Symbol: BOLL
  Gene Name: boule-like RNA-binding protein
  ENST ID: ENST00000434976
  CDS Start-End: 310-573
agacgccccggctcggagtcccagggccacagccgaaactcgccctcccgcgcccctctccggcttgcagcgcccgcccgcaccgccacctgccacccgaggcgacgcagtccgcttctccccacccgccaggtggcaggttcagggccggggtccgagcctgcttccctgcagctgccacagccaccctcgccgccagggggcgagagtcccaggcaggacaagcagcgctgctgccttggcgtgaaggtggtttcaaactttaggcttcttttccctaccccgcgtctctgaagagcagagaggaagatggaaaccgagtccgggccgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaat

SEQ ID NO: 111816 - DNA, 1079 bp, Homo sapiens
  Payload ID: 1911
  Gene Symbol: BPIFA1
  Gene Name: BPI fold containing family A, member 1
  Uniprot ID: Q9NP55
  ENST ID: ENST00000354297
  CDS Start-End: 72-842
tgagtgggggagagagaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgggtcttcccccaacagaactatttcttgctgctcaatccatttcctctggcccagcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcatca

SEQ ID NO: 111817 - DNA, 1026 bp, Homo sapiens
  Payload ID: 1911
  Gene Symbol: BPIFA1
  Gene Name: BPI fold containing family A, member 1
  Uniprot ID: Q9NP55
  ENST ID: ENST00000375413
  CDS Start-End: 72-842
tgagtgggggagagagaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcatcagg

SEQ ID NO: 111818 - DNA, 1063 bp, Homo sapiens
  Payload ID: 1911
  Gene Symbol: BPIFA1
  Gene Name: BPI fold containing family A, member 1
  Uniprot ID: Q9NP55
  ENST ID: ENST00000375422
  CDS Start-End: 72-842
tgagtgggggagagagaggagaccaggacagctgctgagacctctaagaagtccagatactaagagcaaagatgtttcaaactgggggcctcattgtcttctacgggctgttagcccagaccatggcccagtttggaggcctgcccgtgcccctggaccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgaactatttcttgctgctcaatccatttcctctggcccagcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgcatca

SEQ ID NO: 111819 - DNA, 907 bp, Homo sapiens
  Payload ID: 1911
  Gene Symbol: BPIFA1
  Gene Name: BPI fold containing family A, member 1
  Uniprot ID: Q9NP55
  ENST ID: ENST00000618484
  CDS Start-End: 1-729
atgtttcaaactgggggcctcattgtcttctacgggctgttagcccagaccctgcccttgaatgtgaatccagccctgcccttgagtcccacaggtcttgcaggaagcttgacaaatgccctcagcaatggcctgctgtctgggggcctgttgggcattctggaaaaccttccgctcctggacatcctgaagcctggaggaggtacttctggtggcctccttgggggactgcttggaaaagtgacgtcagtgattcctggcctgaacaacatcattgacataaaggtcactgacccccagctgctggaacttggccttgtgcagagccctgatggccaccgtctctatgtcaccatccctctcggcataaagctccaagtgaatacgcccctggtcggtgcaagtctgttgaggctggctgtgaagctggacatcactgcagaaatcttagctgtgagagataagcaggagaggatccacctggtccttggtgactgcacccattcccctggaagcctgcaaatttctctgcttgatggacttggccccctccccattcaaggtcttctggacagcctcacagggatcttgaataaagtcctgcctgagttggttcagggcaacgtgtgccctctggtcaatgaggttctcagaggcttggacatcaccctggtgcatgacattgttaacatgctgatccacggactacagtttgtcatcaaggtctaagccttccaggaaggggctggcctctgctgagctgcttcccagtgctcacagatggctggcccatgtgctggaagatgacacagttgccttctctccgaggaacctgccccctctcctttcccaccaggcgtgtgtaacatcccatgtgcctcacctaataaaatggctcttcttctgc

SEQ ID NO: 111820 - DNA, 1122 bp, Homo sapiens
  Payload ID: 1912
  Gene Symbol: BPIFA2
  Gene Name: BPI fold containing family A, member 2
  Uniprot ID: Q96DR5
  ENST ID: ENST00000253362
  CDS Start-End: 147-896
ggagaatttgcaggggggtgacatcctcagacctggcccttggcactgggaagagttgatgcaaagaaattctgcgaggccagagaggaggctttgggaattgtccagcagaaacagagaagtctgaggtggtgtcaagacaaaagatgcttcagctttggaaacttgttctcctgtgcggcgtgctcactgggacctcagagtctcttcttgacaatcttggcaatgacctaagcaatgtcgtggataagctggaacctgttcttcacgagggacttgagacagttgacaatactcttaaaggcatccttgagaaactgaaggtcgacctaggagtgcttcagaaatccagtgcttggcaactggccaagcagaaggcccaggaagctgagaaattgctgaacaatgtcatttctaagctgcttccaactaacacggacatttttgggttgaaaatcagcaactccctcatcctggatgtcaaagctgaaccgatcgatgatggcaaaggccttaacctgagcttccctgtcaccgcgaatgtcactgtggccgggcccatcattggccagattatcaacctgaaagcctccttggacctcctgaccgcagtcacaattgaaactgatccccagacacaccagcctgttgccgtcctgggagaatgcgccagtgacccaaccagcatctcactttccttgctggacaaacacagccaaatcatcaacaagttcgtgaatagcgtgatcaacacgctgaaaagcactgtatcctccctgctgcagaaggagatatgtccactgatccgcatcttcatccactccctggatgtgaatgtcattcagcaggtcgtcgataatcctcagcacaaaacccagctgcaaaccctcatctgaagaggacgaatgaggaggaccactgtggtgcatgctgattggttcccagtggcttgccccacccccttatagcatctccctccaggaagctgctgccaccacctaaccagcgtgaaagcctgagtcccaccagaaggaccttcccagataccccttctcctcacagtcagaacagcagcctctacacatgttgtcctgcccctggcaataaaggcccatttctgca

SEQ ID NO: 111821 - DNA, 1047 bp, Homo sapiens
  Payload ID: 1912
  Gene Symbol: BPIFA2
  Gene Name: BPI fold containing family A, member 2
  Uniprot ID: Q96DR5
  ENST ID: ENST00000354932
  CDS Start-End: 72-821
atcccagcagactgtgcagtggggcaaggatttcatgagcatcctcctctaaacgcgtgtcaagacaaaagatgcttcagctttggaaacttgttctcctgtgcggcgtgctcactgggacctcagagtctcttcttgacaatcttggcaatgacctaagcaatgtcgtggataagctggaacctgttcttcacgagggacttgagacagttgacaatactcttaaaggcatccttgagaaactgaaggtcgacctaggagtgcttcagaaatccagtgcttggcaactggccaagcagaaggcccaggaagctgagaaattgctgaacaatgtcatttctaagctgcttccaactaacacggacatttttgggttgaaaatcagcaactccctcatcctggatgtcaaagctgaaccgatcgatgatggcaaaggccttaacctgagcttccctgtcaccgcgaatgtcactgtggccgggcccatcattggccagattatcaacctgaaagcctccttggacctcctgaccgcagtcacaattgaaactgatccccagacacaccagcctgttgccgtcctgggagaatgcgccagtgacccaaccagcatctcactttccttgctggacaaacacagccaaatcatcaacaagttcgtgaatagcgtgatcaacacgctgaaaagcactgtatcctccctgctgcagaaggagatatgtccactgatccgcatcttcatccactccctggatgtgaatgtcattcagcaggtcgtcgataatcctcagcacaaaacccagctgcaaaccctcatctgaagaggacgaatgaggaggaccactgtggtgcatgctgattggttcccagtggcttgccccacccccttatagcatctccctccaggaagctgctgccaccacctaaccagcgtgaaagcctgagtcccaccagaaggaccttcccagataccccttctcctcacagtcagaacagcagcctctacacatgttgtcctgcccctggcaataaaggcccatttctgca

SEQ ID NO: 111822 - DNA, 983 bp, Homo sapiens
  Payload ID: 1913
  Gene Symbol: BPIFA3
  Gene Name: BPI fold containing family A, member 3
  Uniprot ID: Q9BQP9
  ENST ID: ENST00000375452
  CDS Start-End: 186-842
aatgtgagcaagccctggtggcagcgccagggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccagggctggtgggctggctaatcagcggcaggaaacaccagcagcagcaagagagcaggtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtg

SEQ ID NO: 111823 - DNA, 1116 bp, Homo sapiens
  Payload ID: 1913
  Gene Symbol: BPIFA3
  Gene Name: BPI fold containing family A, member 3
  Uniprot ID: Q9BQP9
  ENST ID: ENST00000375454
  CDS Start-End: 211-975
ccagggttccacatgttgctctcccaatgtgagcaagccctggtggcagcgccagggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccagggctggtgggctggctaatcagcggcaggaaacaccagcagcagcaagagagcagcatcaacatcaccaacattcagctggactgtggtgggatccagatatcattccataaggagtggttctcggcaaatatctcacttgaatttgaccttgaattgagaccgtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtg

SEQ ID NO: 111824 - DNA, 1727 bp, Homo sapiens
  Payload ID: 1914
  Gene Symbol: BPIFB1
  Gene Name: BPI fold containing family B, member 1
  Uniprot ID: Q8TDL5
  ENST ID: ENST00000253354
  CDS Start-End: 162-1616
ggtctgaggcctctgcctaaagacaaagcctgtgctggggtgtgcaggatataaggttggacttccagacccactgcccgggagaggagaggagcgggccgaggactccagcgtgcccaggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaagtggccccacccgcctggtcctcagtgactgtgccaccagccatgggagcctgcgcatccaactgctgcataagctctccttcctggtgaacgccttagctaagcaggtcatgaacctcctagtgccatccctgcccaatctagtgaaaaaccagctgtgtcccgtgatcgaggcttccttcaatggcatgtatgcagacctcctgcagctggtgaaggtgcccatttccctcagcattgaccgtctggagtttgaccttctgtatcctgccatcaagggtgacaccattcagctctacctgggggccaagttgttggactcacagggaaaggtgaccaagtggttcaataactctgcagcttccctgacaatgcccaccctggacaacatcccgttcagcctcatcgtgagtcaggacgtggtgaaagctgcagtggctgctgtgctctctccagaagaattcatggtcctgttggactctgtgcttcctgagagtgcccatcggctgaagtcaagcatcgggctgatcaatgaaaaggctgcagataagctgggatctacccagatcgtgaagatcctaactcaggacactcccgagttttttatagaccaaggccatgccaaggtggcccaactgatcgtgctggaagtgtttccctccagtgaagccctccgccctttgttcaccctgggcatcgaagccagctcggaagctcagttttacaccaaaggtgaccaacttatactcaacttgaataacatcagctctgatcggatccagctgatgaactctgggattggctggttccaacctgatgttctgaaaaacatcatcactgagatcatccactccatcctgctgccgaaccagaatggcaaattaagatctggggtcccagtgtcattggtgaaggccttgggattcgaggcagctgagtcctcactgaccaaggatgcccttgtgcttactccagcctccttgtggaaacccagctctcctgtctcccagtgaagacttggatggcagccatcagggaaggctgggtcccagctgggagtatgggtgtgagctctatagaccatccctctctgcaatcaataaacacttgcctgtgatgcctgc

SEQ ID NO: 111825 - DNA, 658 bp, Homo sapiens
  Payload ID: 1914
  Gene Symbol: BPIFB1
  Gene Name: BPI fold containing family B, member 1
  ENST ID: ENST00000423645
  CDS Start-End: 217-658
acaacttcaagggaggtgccctgtggttgccccatgcttccctcctggccaccaggaatcaggacaagcaaagaacacgacattcacagtccagggaggtcacacagtccggaaaggtacaaagggtttggagaactcacttcatttggtttgggagcctccgcaggtggacacggtctggcatcctgcacttgctgccctctgacacctgggaagatggccggcccgtggaccttcacccttctctgtggtttgctggcagccaccttgatccaagccaccctcagtcccactgcagttctcatcctcggcccaaaagtcatcaaagaaaagctgacacaggagctgaaggaccacaacgccaccagcatcctgcagcagctgccgctgctcagtgccatgcgggaaaagccagccggaggcatccctgtgctgggcagcctggtgaacaccgtcctgaagcacatcatctggctgaaggtcatcacagctaacatcctccagctgcaggtgaagccctcggccaatgaccaggagctgctagtcaagatccccctggacatggtggctggattcaacacgcccctggtcaagaccatcgtggagttccacatgacgactgaggcccaagccaccatccgcatggacaccagtgcaa

SEQ ID NO: 111826 - DNA, 1898 bp, Homo sapiens
  Payload ID: 1915
  Gene Symbol: BPIFB2
  Gene Name: BPI fold containing family B, member 2
  Uniprot ID: Q8N4F0
  ENST ID: ENST00000170150
  CDS Start-End: 196-1572
aaaacacttgcaaccacaagcaaactcgccgctccctgggtcccttcccagtggactctgcacattgggagccttataaagtagcctctgcatctgcctgcctcgggcagaggagggctaccctggggctgagagttcacctgtctcaggaaccacctgagcccacagatcctgtgggcagcggccagggcagccatggcttgggcaagtaggctgggcctgctgctggcactgctgctgcccgtggtcggtgcctccacgccaggcaccgtggtccgactcaacaaggcagcattgagctacgtgtctgaaattgggaaagcccctctccagcgggccctgcaggtcactgtccctcatttcctggactggagtggagaggcgcttcagcccaccaggatccggattctgaatgtccatgtgccccgcctccacctgaaattcattgctggtttcggagtgcgcctgctggcagcagctaattttactttcaaggtctttcgcgccccagagcccctggagctgacgctgcctgtggaactgctggctgacacccgcgtgacccagagctccatcaggacccctgtggtcagcatctctgcctgctctttattctcgggccacgccaacgagtttgatggcagtaacagcacctcccacgcgctgctggtcctggtgcagaagcacattaaagctgtcttgagtaacaagctgtgcctgagcatctccaacctggtgcagggtgtcaatgtccacctgggcaccttaattggcctcaaccccgtgggtcctgagtcccagatccgctattccatggtcagtgtgcccactgtcaccagtgactacatttccctggaagtcaatgctgttctcttcctgctgggcaagcccatcatcctgcccacggatgccaccccttttgtgttgccaaggcatgtgggtaccgagggctccatggccaccgtgggcctctcccagcagctgtttgactctgcgctcctgctgctgcagaaggccggtgccctcaacctggacatcacagggcagctgaggtcggatgacaacctgctgaacacctctgctctgggccggctcatcccggaggtggcccgccagtttcccgagcccatgcctgtggtgctcaaggtgcggctgggtgccacacctgtggccatgctccacacaaacaacgccaccctgcggctgcagcccttcgtggaggtcctggccacagcctccaactcggctttccagtccctcttctccctggatgtggtagtgaacttgagactccagctctctgtgtccaaggtgaagcttcaggggaccacgtctgtgctgggggatgtccagctcacggtggcctcctccaacgtgggcttcattgatacagatcaggtgcgcacactgatgggcaccgtttttgagaagcccctgctggaccatctcaatgctctcttggccatgggaattgccctccctggtgtggtcaacctccactatgtcgcccctgagatctttgtctatgagggctacgtggtgatatccagtggactcttctaccagagctgaggcaagaccactgggaggcctgagagtgggccagctcgctgctcaggcgaatttctcatttcaagccactggggaaactgaggcaaaaccatacttagtcatcaccaacaagctggactgcttagctgggctgttttatcttccctgagtgcctgggtctccctccctcacttctgccctttcccttcctcctcctcttctcctccctcttccctcatctcccccctccttcctctgccccaccccagcggggagcagactgctcctccaggctgtatagacctgccctcttgcattaaacaacttctcttgagctgcaactttca

SEQ ID NO: 111827 - DNA, 1454 bp, Homo sapiens
  Payload ID: 1916
  Gene Symbol: BPIFB3
  Gene Name: BPI fold containing family B, member 3
  Uniprot ID: P59826
  ENST ID: ENST00000375494
  CDS Start-End: 1-1431
atgcagccagtcatgctggccctgtggtccctgcttctgctctggggcctggcgactccatgccaggagctgctagagacggtgggcacgctcgctcggattgacaaggatgaactcggcaaagccatccagaactcactggttggggagcccattctgcagaatgtgctgggatcggtcacagctgtgaaccggggcctcttgggctcaggagggctgcttggaggaggcggcttgctgggccacggaggggtttttggcgttgtcgaggagctctctggtctgaagattgaggagctcacgctgccaaaggtgttgctgaagctgctgccgggatttggggtgcagctgagcctgcacaccaaagtgggcatgcattgctctggcccccttggtggccttctgcagctggctgcggaggtgaacgtgacatcgcgggtggcgctggccgtgagctcaaggggcacacccatccttatcctcaagcgctgcagcacgctcctgggccacatcagcctgttctcagggctgctgcccacaccactctttggggtcgtggaacagatgctcttcaaggtgcttccgggactgctgtgccccgtggtggacagtgtgctgggtgtggtgaatgagctcctgggggctgtgctgggcctggtgtcccttggggctcttgggtccgtggaattctctctggccacattgcctctcatctccaaccagtacatagaactggacatcaaccctatcgtgaagagtgtagctggtgatatcattgacttccccaagtcccgtgccccagccaaggtgccccccaagaaggaccacacatcccaggtgatggtgccactgtacctcttcaacaccacgtttggactcctgcagaccaacggcgccctcgacatggacatcacccctgagctggttcccagcgatgtcccactgacaactacagacctggcagctttgctccctgaggccctggggaagctgcccctgcaccagcaactcctactgttcctgcgggtgagggaagctcccacggtcacactccacaacaagaaggccttggtctccctcccagccaacatccatgtgctgttctatgtccctaaggggacccctgaatccctctttgagctgaactccgtcatgactgtgcgtgcccagctggctccctcggctaccaagctgcacatctccctgtccctggaacggctcagtgtcaaggtggcctcctcctttacccatgcctttgacggatcgcgtttagaagaatggctcagccatgtggtcggggcagtgtatgcaccaaagcttaacgtggccctggatgttggaattcccctgcctaaggttcttaatatcaatttttccaattcagttctggagatcgtagagaatgctgttgtgctgaccgtggcatcctgaggctgagacatggccaccagcct

SEQ ID NO: 111828 - DNA, 2159 bp, Homo sapiens
  Payload ID: 1917
  Gene Symbol: BPIFB4
  Gene Name: BPI fold containing family B, member 4
  Uniprot ID: P59827
  ENST ID: ENST00000375483
  CDS Start-End: 1-1845
atgtggatggcctggtgtgtggctgcgctgtctgtggtggctgtgtgtggcaccagccacgagacaaacacggtcctcagggtgacgaaagatgtgttgagcaatgccatttcaggcatgctgcagcaaagtgatgctctccactcggccctgagagaggtgcccttgggtgttggtgatattccctacaatgacttccatgtccgaggaccccccccagtatataccaacggcaaaaaacttgatggtatttaccagtatggtcacattgagaccaacgacaacactgctcagctggggggcaaataccgatatggtgagatccttgagtccgagggaagcatcagggacctccgaaacagtggctatcgcagtgccgagaatgcatatggaggccacaggggcctcgggcgatacagggcagcacctgtgggcaggcttcaccggcgagagctgcagcctggagaaatcccacctggagttgccactggggcggtgggcccaggtggtttgctgggcactggaggcatgctggcagctgatggcatcctcgcaggccaaggtggcctgctcggcggaggtggtctccttggtgatggaggacttcttggaggagggggtgtcctgggcgtgctcggcgagggtggcatcctcagcactgtgcaaggcatcacggggctgcgtatcgtggagctgaccctccctcgggtgtccgtgcggctcctgcccggcgtgggtgtctacctgagcttgtacacccgtgtggccatcaacgggaagagtcttattggcttcctggacatcgcagtagaagtgaacatcacagccaaggtccggctgaccatggaccgcacgggttatcctcggctggtcattgagcgatgtgacaccctcctagggggcatcaaagtcaagctgctgcgagggcttctccccaatctcgtggacaatttagtgaaccgagtcctggccgacgtcctccctgacttgctctgccccatcgtggatgtggtgctgggtcttgtcaatgaccagctgggcctcgtggattctctgattcctctggggatattgggaagtgtccagtacaccttctccagcctcccgcttgtgaccggggaattcctggagctggacctcaacacgctggttggggaggctggaggaggactcatcgactacccattggggtggccagctgtgtctcccaagccgatgccagagctgcctcccatgggtgacaacaccaagtcccagctggccatgtctgccaacttcctgggctcagtgctgactctactgcagaagcagcatgctctagacctggatatcaccaatggcatgtttgaagagcttcctccacttaccacagccacactgggagccctgatccccaaggtgttccagcagtaccccgagtcctgcccacttatcatcaggatccaggtgctgaacccaccatctgtgatgctgcagaaggacaaagcgctggtgaaggtgttggccactgccgaggtcatggtctcccagcccaaagacctggagactaccatctgcctcattgacgtggacacagaattcttggcctcattttccacagaaggagataagctcatgattgatgccaagctggagaagaccagcctcaacctcagaacctcaaacgtgggcaactttgatattggcctcatggaggtgctggtggagaagatttttgacctggcattcatgcccgcaatgaacgctgtgctgggttctggcgtccctctccccaaaatcctcaacatcgactttagcaatgcagacattgacgtgttggaggaccttttggtgctgagcgcatgagtgacagaggcagagatgctgctgcaactggaagaagctggaaccagtcccagagaggctcggcctggaaacagtcccctgcccagagtcccctcagcctccatgacaggtccctccctggccccccaaccctcttcctcccttgccccaaccctgagaaagggtccagccactaccctgttggcaaacattcccttccatggtcagcctgccaggaggaggggagtcaccttggggctggaggcctctcagaccccatcctgacagcaggttgagtattcccactttcaataaaagactccactttcccggca

SEQ ID NO: 111829 - DNA, 554 bp, Homo sapiens
  Payload ID: 1917
  Gene Symbol: BPIFB4
  Gene Name: BPI fold containing family B, member 4
  ENST ID: ENST00000445356
  CDS Start-End: 184-318
aaaagcagaggggctggggaacaggacttctcaagactcagcggcagggacctcctaggggggtctgaaataacagtcccaaagtaataacaatagctgctctttattgagtgtctactatgtatgagatacaacttgtttgtgatttgggagcagaagttcaaaaagggaagcagtgccagcatgtggatggcctggtgtgtggctgcgctgtctgtggtggctgtgtgtggcaccagccacgagacaaacacggtcctcagggtgacgaaagatgtgttgagcaatggcttctccccaatctcgtggacaatttagtgaaccgagtcctggccgacgtcctccctgacttgctctgccccatcgtggatgtggtgctgggtcttgtcaatgaccagctgggcctcgtggattctctgattcctctggggatattgggaagtgtccagtacaccttctccagcctcccgcttgtgaccggggaattcctggagctggacctcaacacgctggttggggaggctggaggaggactcatcgactacccattgggg

SEQ ID NO: 111830 - DNA, 1362 bp, Homo sapiens
  Payload ID: 1918
  Gene Symbol: BPIFB6
  Gene Name: BPI fold containing family B, member 6
  Uniprot ID: Q8NFQ5
  ENST ID: ENST00000349552
  CDS Start-End: 1-1362
atgctgcggatcctgtgcctggcactctgcagcctgctgactggcacgcgagctgaccctggggcactgctgcggttgggcatggacatcatgaaccaggtccagagcgccatggatgagagtcatatcctggagaagatggcagccgaggcaggcaagaaacagccagggatgaaacctatcaagggcatcaccaatttgaaggtgaaggatgtccagctgcccgtcatcacactgaactttgtacctggagtgggcatcttccaatgtgtgtccacaggcatgaccgtcactggcaagagcttcatgggagggaacatggagatcatcgtggccctgaacatcacagccaccaaccggcttctgcgggatgaggagacaggcctccccgtgttcaagagtgagggctgtgaggtcatcctggtcaatgtgaagactaacctgcctagcaacatgctccccaagatggtcaacaagttcctggacagcaccctgcacaaagtcctccctgggctgatgtgtcccgccatcgatgcagtcctggtgtatgtgaacaggaagtggaccaacctcagtgaccccatgcctgtgggccagatgggcaccgtcaaatatgttctgatgtccgcaccagccaccacagccagctacatccaactggacttcagtcctgtggtgcagcagcaaaagggcaaaaccatcaagcttgctgatgccggggaggccctcacgttccctgagggttatgccaaaggctcgtcgcagctgctgctcccagccaccttcctctctgcagagcttgcccttctgcagaagtcctttcatgtgaatatccaggatacaatgattggtgagctgcccccacaaaccaccaagaccctggctcgcttcattcctgaagtggctgtagcttatcccaagtcaaagcccttgacgacccagatcaagataaagaagcctcccaaggtcactatgaagacaggcaagagcctgctgcacctccacagcaccctggagatgttcgcagctcggtggcggagcaaggctccaatgtccctctttctcctagaagtgcacttcaatctgaaggtccagtactcagtgcatgagaaccagctgcagatggccacttctttggacagattactgagcttgtcccggaagtcctcatcgattggcaacttcaatgagagggaattaactggcttcatcaccagctatctcgaagaagcctacatcccagttgtcaatgatgtgcttcaagtggggctcccactcccggactttctggccatgaattacaacctggctgagctggacatagtagagaatgccctgatgctggacttgaagctgggctga

SEQ ID NO: 111831 - DNA, 1670 bp, Homo sapiens
  Payload ID: 1918
  Gene Symbol: BPIFB6
  Gene Name: BPI fold containing family B, member 6
  ENST ID: ENST00000542375
  CDS Start-End: 1-267
atgctgcggatcctgtgcctggcactctgcagcctgctgactggcacgcgagctgaccctggggcactgctgcggttgggcatggacatcatgaaccgtgaggtccagagcgccatggatgagagtcatatcctggagaagatggcagccgaggcaggcaagaaacagccagggatgaaacctatcaagggcatcaccaatgagcagggtcattttgaggaggaaatgaggttggaaagtcaaatttcaactctgcatgcaacatgaactcattgaatgtacgtgaaattaaatgaaaacatcctcaaatggtagagctggaaaggcatcaacaatcatctaatgacaagaggaaactggttcctctgccagtgccacatgagattgatcagtaggggctgcctgaaacgatgcacttgggagggctctgaggcactgtctgcactcggcaggaactaggactgtgatcaactagcaatgtctgccaagagctcaggatgggcaagtggggtttgaaggtgaaggatgtccagctgcccgtcatcacactgaactttgtacctggagtgggcatcttccaatgtgtgtccacaggcatgaccgtcactggcaagagcttcatgggagggaacatggagatcatcgtggccctgaacatcacagccaccaaccggcttctgcgggatgaggagacaggcctccccgtgttcaagagtgagggctgtgaggtcatcctggtcaatgtgaagactaacctgcctagcaacatgctccccaagatggtcaacaagttcctggacagcaccctgcacaaagtcctccctgggctgatgtgtcccgccatcgatgcagtcctggtgtatgtgaacaggaagtggaccaacctcagtgaccccatgcctgtgggccagatgggcaccgtcaaatatgttctgatgtccgcaccagccaccacagccagctacatccaactggacttcagtcctgtggtgcagcagcaaaagggcaaaaccatcaagcttgctgatgccggggaggccctcacgttccctgagggttatgccaaaggctcgtcgcagctgctgctcccagccaccttcctctctgcagagcttgcccttctgcagaagtcctttcatgtgaatatccaggatacaatgattggtgagctgcccccacaaaccaccaagaccctggctcgcttcattcctgaagtggctgtagcttatcccaagtcaaagcccttgacgacccagatcaagataaagaagcctcccaaggtcactatgaagacaggcaagagcctgctgcacctccacagcaccctggagatgttcgcagctcggtggcggagcaaggctccaatgtccctctttctcctagaagtgcacttcaatctgaaggtccagtactcagtgcatgagaaccagctgcagatggccacttctttggacagattactgagcttgtcccggaagtcctcatcgattggcaacttcaatgagagggaattaactggcttcatcaccagctatctcgaagaagcctacatcccagttgtcaatgatgtgcttcaagtggggctcccactcccggactttctggccatgaattacaacctggctgagctggacatagtagagaatgccctgatgctggacttgaagctg

SEQ ID NO: 111832 - DNA, 1980 bp, Homo sapiens
  Payload ID: 1919
  Gene Symbol: BPIFC
  Gene Name: BPI fold containing family C
  Uniprot ID: Q8NFQ6
  ENST ID: ENST00000300399
  CDS Start-End: 1-1524
atgtgtacaaagacaatcccagtcctctggggatgtttcctcctgtggaatctctatgtctcatcctctcagaccatttaccctggaatcaaggcaaggattactcagagggcacttgactatggtgttcaagctggaatgaagatgattgagcaaatgctaaaagaaaagaaactcccagatttaagcggttctgagtctcttgaatttctaaaagttgattatgtaaactacaatttttcaaatataaaaatcagtgccttttcatttccaaatacctcattggcttttgtgcctggagtgggaatcaaagcgctaaccaaccatggcactgccaacatcagcacagactgggggttcgagtctccacttttccaagacacaggaggggctgatctgtttctctccggagtctactttaccggtatcattatcctaacccgaaatgactttggtcatcctaccctgaagctccaagattgctacgcccaactgagccatgcccacgtctcattttccggagaactcagtgttctgtataactcctttgctgagcccatggagaaacccattttaaagaacttaaatgaaatgctctgtcccattattgcaagtgaagtcaaagcgctaaatgccaacctcagcacactggaggttttaaccaagattgacaactacactctgctggattactccctaatcagttctccagaaattactgagaactaccttgacctgaacttgaagggtgtattctacccactggaaaacctcaccgacccccccttctcaccagttccttttgtgctcccagaacgcagcaactccatgctctacattggaatcgccgagtatttctttaaatctgcgtcctttgctcatttcacagctggggttttcaatgtcactctctccaccgaagagatttccaaccattttgttcaaaactctcaaggccttggcaacgtgctctcccggattgcagagatctacatcttgtcccagcccttcatggtgaggatcatggccacagagcctcccataatcaatctacaaccaggcaatttcaccctggacatccctgcctccatcatgatgctcacccaacccaagaactccacagttgaaaccatcgtttccatggacttcgttgctagtaccagtgttggcctggttattttgggacaaagactggtctgctccttgtctctgaacagattccgccttgctttgccagagtccaatcgcagcaacattgaggtcttgaggtttgaaaatattctatcgtccattcttcactttggagtcctcccactggccaatgcaaaattgcagcaaggatttcctctgtccaatccacacaaattcttattcgtcaattcagatattgaagttcttgagggtttccttttgatttccaccgacctgaagtatgaaacatcctcaaagcagcagccaagtttccacgtatgggaaggtctgaacctgataagcagacagtggagggggaagtcagccccttgattgccggtttgcaattcaccccaggaagtaaatggtccttaatcctacaactactgtaaacccagaagggaaagacagtacacactggaattgtaaagcccttgtgaattgcttaggcagaaagttttctttcttaagccttcaggaacccagaataaggcagactctgttaaagggataaatagaggtgtctgaatgtgagtgtatgcatgctgcgtgtgtctgtgtttatgtttgtttgtttgtttggggcaagaaagattctaggacaagagctaggcatgtacttctgaccaggtgggtaagcaactctaagtctgtatttgtattggtcattctcagtggaaatcccttaggccctctagtggttttcccctacctgcatattggttttcatgttttatattcactgttactatcttctgtgtttaattaaaattgttttctatcaacttc

SEQ ID NO: 111833 - DNA, 458 bp, Homo sapiens
  Payload ID: 1919
  Gene Symbol: BPIFC
  Gene Name: BPI fold containing family C
  ENST ID: ENST00000397450
  CDS Start-End: 165-413
ggtggagaacacatcagcttcaaaggcagagagaatcgaaggtgctctccagctttggacacttcctctgcttgaggacaccttgactaacctccaagggcaactaaaggatcaagaaaggcccagcacagcagaagatcagctggatctagctcctgcaggagatgtgtacaaagacaatcccagtcctctggggatgtttcctcctgtggaatctctatgtctcatcctctcagaccatttaccctggaatcaaggcaaggattactcagagggcacttgactatggtgttcaagctggaatgaagatgattgagcaaatgctaaaagaaaagaaactcccagatttaagcggttctgagtctcttgaatttctaaaagttgattatgtaaactacaatttttcaaagtaagtaaaaagaagagcattttgcctcttataagaagctcaaaggaaa

SEQ ID NO: 111834 - DNA, 2091 bp, Homo sapiens
  Payload ID: 1919
  Gene Symbol: BPIFC
  Gene Name: BPI fold containing family C
  Uniprot ID: Q8NFQ6
  ENST ID: ENST00000397452
  CDS Start-End: 112-1635
atcttggctttttagcagctgagtttaaggcgcaaggtggagaacacatcagcttcaaaggcagagagaatcgaaggtgctctccagctttggacacttcctctgcttgagatgtgtacaaagacaatcccagtcctctggggatgtttcctcctgtggaatctctatgtctcatcctctcagaccatttaccctggaatcaaggcaaggattactcagagggcacttgactatggtgttcaagctggaatgaagatgattgagcaaatgctaaaagaaaagaaactcccagatttaagcggttctgagtctcttgaatttctaaaagttgattatgtaaactacaatttttcaaatataaaaatcagtgccttttcatttccaaatacctcattggcttttgtgcctggagtgggaatcaaagcgctaaccaaccatggcactgccaacatcagcacagactgggggttcgagtctccacttttccaagacacaggaggggctgatctgtttctctccggagtctactttaccggtatcattatcctaacccgaaatgactttggtcatcctaccctgaagctccaagattgctacgcccaactgagccatgcccacgtctcattttccggagaactcagtgttctgtataactcctttgctgagcccatggagaaacccattttaaagaacttaaatgaaatgctctgtcccattattgcaagtgaagtcaaagcgctaaatgccaacctcagcacactggaggttttaaccaagattgacaactacactctgctggattactccctaatcagttctccagaaattactgagaactaccttgacctgaacttgaagggtgtattctacccactggaaaacctcaccgacccccccttctcaccagttccttttgtgctcccagaacgcagcaactccatgctctacattggaatcgccgagtatttctttaaatctgcgtcctttgctcatttcacagctggggttttcaatgtcactctctccaccgaagagatttccaaccattttgttcaaaactctcaaggccttggcaacgtgctctcccggattgcagagatctacatcttgtcccagcccttcatggtgaggatcatggccacagagcctcccataatcaatctacaaccaggcaatttcaccctggacatccctgcctccatcatgatgctcacccaacccaagaactccacagttgaaaccatcgtttccatggacttcgttgctagtaccagtgttggcctggttattttgggacaaagactggtctgctccttgtctctgaacagattccgccttgctttgccagagtccaatcgcagcaacattgaggtcttgaggtttgaaaatattctatcgtccattcttcactttggagtcctcccactggccaatgcaaaattgcagcaaggatttcctctgtccaatccacacaaattcttattcgtcaattcagatattgaagttcttgagggtttccttttgatttccaccgacctgaagtatgaaacatcctcaaagcagcagccaagtttccacgtatgggaaggtctgaacctgataagcagacagtggagggggaagtcagccccttgattgccggtttgcaattcaccccaggaagtaaatggtccttaatcctacaactactgtaaacccagaagggaaagacagtacacactggaattgtaaagcccttgtgaattgcttaggcagaaagttttctttcttaagccttcaggaacccagaataaggcagactctgttaaagggataaatagaggtgtctgaatgtgagtgtatgcatgctgcgtgtgtctgtgtttatgtttgtttgtttgtttggggcaagaaagattctaggacaagagctaggcatgtacttctgaccaggtgggtaagcaactctaagtctgtatttgtattggtcattctcagtggaaatcccttaggccctctagtggttttcccctacctgcatattggttttcatgttttatattcactgttactatcttctgtgtttaattaaaattgttttctatcaacttc

SEQ ID NO: 111835 - DNA, 1809 bp, Homo sapiens
  Payload ID: 1919
  Gene Symbol: BPIFC
  Gene Name: BPI fold containing family C
  Uniprot ID: Q8NFQ6
  ENST ID: ENST00000534972
  CDS Start-End: 559-1353
atgtgtacaaagacaatcccagtcctctggggatgtttcctcctgtggaatctctatgtctcatcctctcagaccatttaccctggaatcaaggcaaggattactcagagggcacttgactatggtgttcaagctggaatgaagatgattgagcaaatgctaaaagaaaagaaactcccagatttaagcggttctgagtctcttgaatttctaaaagttgattatgtaaactacaatttttcaaatataaaaatcagtgccttttcatttccaaatacctcattggcttttgtgcctggagtgggaatcaaagcgctaaccaaccatggcactgccaacatcagcacagactgggggttcgagtctccacttttccaagacacaggaggggctgatctgtttctctccggagtctactttaccggtatcattatcctaacccgaaatgactttggtcatcctaccctgaagctccaagattgctacgcccaactgagccatgcccacgtctcattttccggagaactcagtgttctgtataactcctttgctgagcccatggagaaacccattttaaagaacttaaatgaaatgctctgtcccattattgcaagtgaagtcaaagcgctaaatgccaacctcagcacactggaggttttaaccaagattgacaactacactctgctggattactccctaatcagttctccagaaattactgagaactaccttgacctgaacttgaagggtgtattctacccactggaaaacctcaccgacccccccttctcaccagttccttttgtgctcccagaacgcagcaactccatgctctacattggaatcgccgagtatttctttaaatctgcgtcctttgctcatttcacagctggggttttcaatgtcactctctccaccgaagagatttccaaccattttgttcaaaactctcaaggccttggcaacgtgctctcccgggttgctagtaccagtgttggcctggttattttgggacaaagactggtctgctccttgtctctgaacagattccgccttgctttgccagagtccaatcgcagcaacattgaggtcttgaggtttgaaaatattctatcgtccattcttcactttggagtcctcccactggccaatgcaaaattgcagcaaggatttcctctgtccaatccacacaaattcttattcgtcaattcagatattgaagttcttgagggtttccttttgatttccaccgacctgaagtatgaaacatcctcaaagcagcagccaagtttccacgtatgggaaggtctgaacctgataagcagacagtggagggggaagtcagccccttgattgccggtttgcaattcaccccaggaagtaaatggtccttaatcctacaactactgtaaacccagaagggaaagacagtacacactggaattgtaaagcccttgtgaattgcttaggcagaaagttttctttcttaagccttcaggaacccagaataaggcagactctgttaaagggataaatagaggtgtctgaatgtgagtgtatgcatgctgcgtgtgtctgtgtttatgtttgtttgtttgtttggggcaagaaagattctaggacaagagctaggcatgtacttctgaccaggtgggtaagcaactctaagtctgtatttgtattggtcattctcagtggaaatcccttaggccctctagtggttttcccctacctgcatattggttttcatgttttatattcactgttactatcttctgtgtttaattaaaattgttttctatcaacttc

SEQ ID NO: 111836 - DNA, 3079 bp, Homo sapiens
  Payload ID: 1920
  Gene Symbol: BRSK1
  Gene Name: BR serine/threonine kinase 1
  Uniprot ID: Q8TDC3
  ENST ID: ENST00000309383
  CDS Start-End: 278-2614
gggggccggccagaaacgggctggggagggggggccccgcagcccccctgggccatgctgactcccggggcctgacccccccgggccagccccccctcccccagctccgcggcccgccgactggggggggccagcccagccccctggggacccccggagaggtggggggcagccgggggggccgggacggagcggtcgccggcccccaccggagagacggggcgacggccgcagggggggcggccgggggaccggtcgggccgggaccaagggcaccatgtcgtccggggccaaggagggaggtgggggctctcccgcctaccacctcccccacccccacccccacccaccccagcacgcccaatatgtgggcccctatcggctggagaagacgctgggcaaaggacagacagggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttgtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgagcagctctccccgccgaggcccccccaaggacaagaagctcctggccaccaacgggacccctctgccctgaccccacggggccggggagggaggggacccccctccaccccccttccgtgccccccaactgtgaatctgtaaataaggcccaaggaacatgtcgggaggggggtggacacaaaaaccggccttgccctgcagggatggggctccacaggccgtgcccaactgggggtggttctaggggaacagggggcgggggagctgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggc

SEQ ID NO: 111837 - DNA, 2095 bp, Homo sapiens
  Payload ID: 1920
  Gene Symbol: BRSK1
  Gene Name: BR serine/threonine kinase 1
  ENST ID: ENST00000326848
  CDS Start-End: 209-1630
agcggctgggaggggtgggatgccagggttcctgagaggcaacgggctagggactcggacttatgggtcctgggggaagaggacacagctagagaaggagtctaggggtcagaggcaggaggggctaagctaggagtccaggactcccagaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgagcagctctccccgccgaggcccccccaaggacaagaagctcctggccaccaacgggacccctctgccctgaccccacggggccggggagggaggggacccccctccaccccccttccgtgccccccaactgtgaatctgtaaataaggcccaaggaacatgtcgggaggggggtggacacaaaaaccggccttgccctgcagggatggggctccacaggccgtgcccaactgggggtggttctaggggaacagggggcgggggagctgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggc

SEQ ID NO: 111838 - DNA, 556 bp, Homo sapiens
  Payload ID: 1920
  Gene Symbol: BRSK1
  Gene Name: BR serine/threonine kinase 1
  ENST ID: ENST00000591774
  CDS Start-End: 162-556
agtctttcattgcgcgcctacatgtgcctacgacctcacttctgcttctctacgactcaccaccctcacagctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctc

SEQ ID NO: 111839 - DNA, 545 bp, Homo sapiens
  Payload ID: 1920
  Gene Symbol: BRSK1
  Gene Name: BR serine/threonine kinase 1
  ENST ID: ENST00000592539
  CDS Start-End: 1-190
ggcggggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttgtaggtttcaccacacgggaagctgtctgcccggcgctcatgggacctgctctcaggctttcccaggtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagg

SEQ ID NO: 111840 - DNA, 1104 bp, Homo sapiens
  Payload ID: 1920
  Gene Symbol: BRSK1
  Gene Name: BR serine/threonine kinase 1
  Uniprot ID: Q8TDC3
  ENST ID: ENST00000585418
  CDS Start-End: 23-1054
tcgggccgggaccaagggcaccatgtcgtccggggccaaggagggaggtgggggctctcccgcctaccacctcccccacccccacccccacccaccccagcacgcccaatatgtgggcccctatcggctggagaagacgctgggcaaaggacagacagggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttgtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggagtaagaccccaagacccctgcacccgtgtacccacgtggggcgagctgcagcag

SEQ ID NO: 111841 - DNA, 2977 bp, Homo sapiens
  Payload ID: 1920
  Gene Symbol: BRSK1
  Gene Name: BR serine/threonine kinase 1
  Uniprot ID: Q8TDC3
  ENST ID: ENST00000590333
  CDS Start-End: 128-2512
gctcacgcctgtaatcccagcactttgggaagctgaggtgggcaaatcacaaggtcaggagtttgagaccagcctgaccaacatggtgaaaccccatctctactaaaaatacaaaaattagccaggcatggtggcggggttaactttggggaagggcccggagtccccggatggtgatgtcagcgtgccggagagaaaggacgaggtggcggggggaggcggagaggaggaggaggcggaggagagagggcgccacgcccaatatgtgggcccctatcggctggagaagacgctgggcaaaggacagacagggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttgtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgagcagctctccccgccgaggcccccccaaggacaagaagctcctggccaccaacgggacccctctgccctgaccccacggggccggggagggaggggacccccctccaccccccttccgtgccccccaactgtgaatctgtaaataaggcccaaggaacatgtcgggaggggggtggacacaaaaaccggccttgccctgcagggatggggctccacaggccgtgcccaactgggggtggttctaggggaacagggggcgggggagctgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggc

SEQ ID NO: 111842 - DNA, 4089 bp, Homo sapiens
  Payload ID: 1921
  Gene Symbol: BRSK2
  Gene Name: BR serine/threonine kinase 2
  Uniprot ID: Q8IWQ3
  ENST ID: ENST00000308219
  CDS Start-End: 387-2393
gctgttcggctcagctgcacggctcggctcggctcggctcggctcggctgcgcggccgctgacgggcgtgcgctgggggcgcggggcgcggggcgcgggcctcggcggcggcggcggcggcggcggcggaagccaggtgcccccgcccgccctgtcctctcgacgaggcggaggcgtcgccgcgggccaggcctcggactgccgcgtcggagtggacgcggggggcggcggcgcgggcggacgcgggcggcgcgaagcagcggggcccgcgggggcgccccggccgggtcggcgcggacggcactcggcggacgcgggcggacgctgggcggcccctccctgcccgcgcgcccgggcgcccctggccggcgccgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaagaattcctgcaagatatttttataaacttttttttcttggtggtttttggaaaagggtgtgggggtgggggcgccgctggggcagggccaggttttgtgttttagtcccttgctcctgcttctttctacacacacatctaaagacggtgcggctcgctctgtcatgggttccgtctctctgtggagaagcagctccacctctgggggggctcggggcagaggggcggtgtcttgtagcgggcggcagcgccagcgcccctctgtcaggctggggcaatcttggttttgtgtccaaaggtgaaggggtaggaggagggccctcagctggccctccccacacacaggacggcaggggcactgtgaggcttttcttattaaaatgaaaaaattgaaaaaaaaggacaaagagtcggtggcgctcctctgcagggcgttctgtgcagagcgaggcccagggcgcagccctcagagggctgcaggcccaccctgcccagtgcccgccgccgtgcttcaccccagctccagcttctgtgttcccttccgcccatgtgcccagccctcccaggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcccttccgcaaa

SEQ ID NO: 111843 - DNA, 3576 bp, Homo sapiens
  Payload ID: 1921
  Gene Symbol: BRSK2
  Gene Name: BR serine/threonine kinase 2
  Uniprot ID: Q8IWQ3
  ENST ID: ENST00000382179
  CDS Start-End: 254-2554
agtctcaggctggctagttcctccttcctggtcactgagccagccttgctgaggggagagcgggttctggacgtgctctgagcttccttcctcacagccttgctcctgggccagatcagcaggaaagcagccagtgccccgccatggcctgcccgggtggggtcctgaagctggggccggagcagggggcacagttctgccccatctggccctagtttggggagggagcctggtagggcaccagcctcaccccatgagccctgagggccaccccagccgatgggcacgtccccgccggccctgcatctgtccttcctccctctgctccccaagagagcccaggtctggcccagcggtgggcaggggaggggccgcacatcacagagtgccagctggccacactcccggcccacagctgctccagccgcacctccaccttcctcaaggccagacctggctctgcctgcagcccagcccagcaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtgacgagaagaacgggcaggcggcccaggcccccagcacgcccgccaagcggagtgcccacggcccactcggtgactccgcggccgctggccctggccccggaggggacgccgagtacccaacgggcaaggacacggccaagatgggcccgcccaccgcccgccgcgagcagccttagacacactagcccccccccccagcacagcactgacagcggctgcctcgccgcccgccgcccgccctgccccgagtggacccgcggccgcgccgcccgtccgtccagactgttctcagagcctgggaggaaaggaaaggggcgttggggccggcctgtgggctgcgccacccgcgcccgctctcttttctctctgtctctgcctctgcctgtctctgacagcatcgcttgtttccactctgataccaggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaagaattcctgcaagatatttttataaactttt

SEQ ID NO: 111844 - DNA, 3163 bp, Homo sapiens
  Payload ID: 1921
  Gene Symbol: BRSK2
  Gene Name: BR serine/threonine kinase 2
  Uniprot ID: Q8IWQ3
  ENST ID: ENST00000531197
  CDS Start-End: 385-2409
tgttcggctcagctgcacggctcggctcggctcggctcggctcggctgcgcggccgctgacgggcgtgcgctgggggcgcggggcgcggggcgcgggcctcggcggcggcggcggcggcggcggcggaagccaggtgcccccgcccgccctgtcctctcgacgaggcggaggcgtcgccgcgggccaggcctcggactgccgcgtcggagtggacgcggggggcggcggcgcgggcggacgcgggcggcgcgaagcagcggggcccgcgggggcgccccggccgggtcggcgcggacggcactcggcggacgcgggcggacgctgggcggcccctccctgcccgcgcgcccgggcgcccctggccggcgccgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctgacgctggcaggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaa

SEQ ID NO: 111845 - DNA, 3586 bp, Homo sapiens
  Payload ID: 1921
  Gene Symbol: BRSK2
  Gene Name: BR serine/threonine kinase 2
  Uniprot ID: Q8IWQ3
  ENST ID: ENST00000528841
  CDS Start-End: 385-2595
tgttcggctcagctgcacggctcggctcggctcggctcggctcggctgcgcggccgctgacgggcgtgcgctgggggcgcggggcgcggggcgcgggcctcggcggcggcggcggcggcggcggcggaagccaggtgcccccgcccgccctgtcctctcgacgaggcggaggcgtcgccgcgggccaggcctcggactgccgcgtcggagtggacgcggggggcggcggcgcgggcggacgcgggcggcgcgaagcagcggggcccgcgggggcgccccggccgggtcggcgcggacggcactcggcggacgcgggcggacgctgggcggcccctccctgcccgcgcgcccgggcgcccctggccggcgccgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtggcagcccattgagtaacttctttgacgtaattaaacaacttttttcagacgagaagaacgggcaggcggcccaggcccccagcacgcccgccaagcggagtgcccacggcccactcggtgactccgcggccgctggccctggccccggaggggacgccgagtacccaacgggcaaggacacggccaagatgggcccgcccaccgcccgccgcgagcagccttagacacactagcccccccccccagcacagcactgacagcggctgcctcgccgcccgccgcccgccctgccccgagtggacccgcggccgcgccgcccgtccgtccagactgttctcagagcctgggaggaaaggaaaggggcgttggggccggcctgtgggctgcgccacccgcgcccgctctcttttctctctgtctctgcctctgcctgtctctgacagcatcgcttgtttccactctgataccaggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaa

SEQ ID NO: 111846 - DNA, 1934 bp, Homo sapiens
  Payload ID: 1921
  Gene Symbol: BRSK2
  Gene Name: BR serine/threonine kinase 2
  ENST ID: ENST00000529951
  CDS Start-End: 1-512
tagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctgacgctggcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcac

SEQ ID NO: 111847 - DNA, 580 bp, Homo sapiens
  Payload ID: 1921
  Gene Symbol: BRSK2
  Gene Name: BR serine/threonine kinase 2
  ENST ID: ENST00000524702
  CDS Start-End: 191-580
acagagcttcaggaaccaccgagatggggagcctgccggagacacaggttttctgagcgcaccagcggctccaaaagcagagggaagagccctgcgtgcaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggag

SEQ ID NO: 111848 - DNA, 3528 bp, Homo sapiens
  Payload ID: 1921
  Gene Symbol: BRSK2
  Gene Name: BR serine/threonine kinase 2
  Uniprot ID: Q8IWQ3
  ENST ID: ENST00000528710
  CDS Start-End: 554-2398
tttgggggcgccgtgaaagcacccagcgtagtcatgctgctgtgtgcgatgggtgctgggcccgcagacttcggtgcttcaaaggcctcactgctgagcacgagacgccgcttttgatgtcgtcaggctctctggtccccgggagtggactcgggggctccgagtgcagggctcacactgtgtctttgagggctggtcacccacccaggcacacctgtggccctgagtcagcactgcctgacgcccaccctcaggagcccccgcctgcctagggtgggaccatgggggaggctggtcctccattctcaggggctgggggacaccccttctggttgagaaggccacaggtggcccccccgccacccggcaggcacagcagggcaccaccgagaccactgtggcctgaggaggagcttcagcagccacttggtaggagggccttcgacggcccttttgtgcagaaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctgacgctggcaggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaagaattcctgcaagatatttttataaacttttttttcttggtggtttttggaaaagggtgtgggggtgggggcgccgctggggcagggccaggttttgtgttttagtcccttgctcctgcttctttctacacacacatctaaagacggtgcggctcgctctgtcatgggttccgtctctctgtggagaagcagctccacctctgggggggctcggggcagaggggcggtgtcttgtagcgggcggcagcgccagcgcccctctgtcaggctggggcaatcttggttttgtgtccaaaggtgaaggggtaggaggagggccctcagctggccctccccacacacaggacggcaggggcactgtgaggcttttcttatt

SEQ ID NO: 111849 - DNA, 2091 bp, Homo sapiens
  Payload ID: 1921
  Gene Symbol: BRSK2
  Gene Name: BR serine/threonine kinase 2
  Uniprot ID: Q8IWQ3
  ENST ID: ENST00000526678
  CDS Start-End: 1-2091
atgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagagtaaagcaatgttcagtaaaagcctggatatcgctgaggcccatccccaattcagcaaagaagacaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctga

SEQ ID NO: 111850 - DNA, 3211 bp, Homo sapiens
  Payload ID: 1921
  Gene Symbol: BRSK2
  Gene Name: BR serine/threonine kinase 2
  Uniprot ID: Q8IWQ3
  ENST ID: ENST00000529433
  CDS Start-End: 385-2409
tgttcggctcagctgcacggctcggctcggctcggctcggctcggctgcgcggccgctgacgggcgtgcgctgggggcgcggggcgcggggcgcgggcctcggcggcggcggcggcggcggcggcggaagccaggtgcccccgcccgccctgtcctctcgacgaggcggaggcgtcgccgcgggccaggcctcggactgccgcgtcggagtggacgcggggggcggcggcgcgggcggacgcgggcggcgcgaagcagcggggcccgcgggggcgccccggccgggtcggcgcggacggcactcggcggacgcgggcggacgctgggcggcccctccctgcccgcgcgcccgggcgcccctggccggcgccgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagcctgttggagaccagctgtgggtccccccactacgcctgccccgaggtgatccggggggagaagtatgacggccggaaggcggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtccatcagcggtgcctcctcaggcctttccaccagcccactcagcagcccccgggtgacccctcacccctcaccaaggggcagtcccctccccacccccaaggggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctgacgctggcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaa

SEQ ID NO: 111851 - DNA, 581 bp, Homo sapiens
  Payload ID: 1921
  Gene Symbol: BRSK2
  Gene Name: BR serine/threonine kinase 2
  ENST ID: ENST00000528596
  CDS Start-End: 322-581
agttggagtgttggtggttttgtaacgaactggtcagagcaccttccgtgagaagggccttttcccccagttcaccggggctcccctgctcagggtgtgccgggggctttgagtcacttctgtgtctccttggaggctgtgtggcgtccgcggaagttggtgtctgtgcggtgtggttctgtttatgggtgttgtagagaaggcgccgtccagagacagagccactgctgaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacct

SEQ ID NO: 111852 - DNA, 2319 bp, Homo sapiens
  Payload ID: 1921
  Gene Symbol: BRSK2
  Gene Name: BR serine/threonine kinase 2
  ENST ID: ENST00000533606
  CDS Start-End: 1-601
cacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaagaattcctgcaagatatttttataaacttttttttcttggtggtttttggaaaagggtgtgggggtgggggcgccgctggggcagggccaggttttgtgttttagtcccttgctcctgcttctttctacacacacatctaaagacggtgcggctcgctctgtcatgggttccgtctctctgtggagaagcagctccacctctgggggggctcggggcagaggggcggtgtcttgtagcgggcggcagcgccagcgcccctctgtcaggctggggcaatcttggttttgtgtccaaaggtgaaggggtaggaggagggccctcagctggccctccccacacacaggacggcaggggcactgtgaggcttttcttattaaaatgaaaaaattgaaaaaaaaggacaaagagtcggtggcgctcctctgcagggcgttctgtgcagagcgaggcccagggcgcagccctcagagggctgcaggcccaccctgcccagtgcccgccgccgtgcttcaccccagctccagcttctgtgttcccttccgcccatgtgcccagccctcccaggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcccttccgcaaagaca

SEQ ID NO: 111853 - DNA, 1842 bp, Homo sapiens
  Payload ID: 1921
  Gene Symbol: BRSK2
  Gene Name: BR serine/threonine kinase 2
  ENST ID: ENST00000544817
  CDS Start-End: 155-667
ggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctgacgctggcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccctggtgggcaacgtagccacaggaacaggccccgtccaccgcctccacgccgcacctggaggcctcctcgcaggcccgtgccccgcctccctggctgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgcggcaccagagccttcccagcaggccaggccgctgggctgggatcagtgttatttatttgccgttttaatttatggattctccgcacctctgttcagggaagggcggcggccacatcccctgccgtctgcgtgtctcaggcagtgggggggctggggccagggcgccctctgaggacagagctggtggggcgcgggggggctggcgagctactgtaaactttaaagaattcctgcaagatatttttataaacttttttttcttggtggtttttggaaaagggtgtgggggtgggggcgccgctggggcagggccaggttttgtgttttagtcccttgctcctgcttctttctacacacacatctaaagacggtgcggctcgctctgtcatgggttccgtctctctgtggagaagcagctccacctctgggggggctcggggcagaggggcggtgtcttgtagcgggcggcagcgccagcgcccctctgtcaggctggggcaatcttggttttgtgtccaaaggtgaaggggtaggaggagggccctcagctggccctccccacacacaggacggcaggggcactgtgaggcttttctt

SEQ ID NO: 111854 - DNA, 1687 bp, Homo sapiens
  Payload ID: 1922
  Gene Symbol: BDKRB1
  Gene Name: bradykinin receptor B1
  Uniprot ID: P46663
  ENST ID: ENST00000216629
  CDS Start-End: 607-1668
attcgaagtggctcccacaaaagctgctgcagagccccagacattcagaagccaatagtgaaggggccaaaagccatccctcaatgttcactgacactttgcgagccttggggcaagttggcgatgtcaaaacatgtttttagggcgtgtttgccaacatacaggtcttgggcaggattgcagacctctgcagatggtaccaaagtaaagggggagatggtagctgaataatctcttatcatccctaaagtgcaaagtgaaatgagagtggatttttccttccaaatccacttggagtgagtcccgaaagactcacttttgcggcaatccccacaatgacatcactggagcggaggttatataatttaaagcaaccacatctccacagcacttcccagaagagaaaactcctccaaaagcagctctcactatcagaaaacccaactacagttgtgaacgccttcattttctgcctgaggtctcagtccgtcggcccagactgaagtgcagtggcacaatcatagctcgctgcagcctcgaccttccaggcttaaacgattctcccacctcagcctctcgagttgctgggaccacaggtcactgtgcatggcatcatcctggccccctctagagctccaatcctccaaccagagccagctcttccctcaaaatgctacggcctgtgacaatgctccagaagcctgggacctgctgcacagagtgctgccaacatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggctgcgatcgtcttcttcaactaccacatcctggcctccctgcgaacgcgggaggaggtcagcaggacaaggtgcgggggccgcaaggatagcaagaccacagcgctgatcctcacgctcgtggttgccttcctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccggctcttcaggaccaaggtctgggaactttataaacaatgcacccctaaaagtcttgctccaatatcttcatcccataggaaagaaatcttccaacttttctggcggaattaaaacagcattgaaccaagaa

SEQ ID NO: 111855 - DNA, 1526 bp, Homo sapiens
  Payload ID: 1922
  Gene Symbol: BDKRB1
  Gene Name: bradykinin receptor B1
  ENST ID: ENST00000553356
  CDS Start-End: 221-1075
agcacttcccagaagagaaaactcctccaaaagcagctctcactatcagaaaacccaactacagttgtgaacgccttcattttctgcctgaggtctcagtccgtcggcccagactgaagtgcagtggcacaatcatagctcgctgcagcctcgaccttccaggcttaaacgattctcccacctcagcctctcgagttgctgggaccacaggtcactgtgcatggcatcatcctggccccctctagagctccaatcctccaaccagagccagctcttccctcaaaatgctacggcctgtgacaatgctccagaagcctgggacctgctgcacagagtgctgccaacatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggctgcgatcgtcttcttcaactaccacatcctggcctccctgcgaacgcgggaggaggtcagcaggacaagctccctgaatccagtaatttatgtctttgtgggccggctcttcaggaccaagccggccttaagcaggtggcttatcaaaatcctttcgaggtcttgcaaaaaccaatcccacactcgagaagaacgtgctggccggtgaaatcggacaacattgctcacgggatgtaattcaatggtagactgcagccacagcctgagaactcagacacctgatttatgagacgcacataagtaacgtttaccgaagcccagcaaatggccccacagtgggagagaaactggcaaacccgtacagtagaattctgttgcccttctgtggggaaggccagttattcatttacagagggagaaatttctgccttgactaaaaggatcgatgctgtgggaaaaggtaatatatctgagttcccatggatctggttgataggttcacctggcgtgttccatatggggccaggcccaggccacacctgtggtgctaacacctggggtggagggaggaattagcaaatagtcttccagcatccccagctccagcacccatgtgggcttccactctctccctgagaagggccaagtagaaagagaga

SEQ ID NO: 111856 - DNA, 1085 bp, Homo sapiens
  Payload ID: 1922
  Gene Symbol: BDKRB1
  Gene Name: bradykinin receptor B1
  Uniprot ID: P46663
  ENST ID: ENST00000611804
  CDS Start-End: 14-1075
caggtcactgtgcatggcatcatcctggccccctctagagctccaatcctccaaccagagccagctcttccctcaaaatgctacggcctgtgacaatgctccagaagcctgggacctgctgcacagagtgctgccaacatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggctgcgatcgtcttcttcaactaccacatcctggcctccctgcgaacgcgggaggaggtcagcaggacaaggtgcgggggccgcaaggatagcaagaccacagcgctgatcctcacgctcgtggttgccttcctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccggctcttcaggaccaaggtctgggaactttataaacaatgcacccctaaaagtcttgctccaatatcttcatcccataggaaagaaatcttccaacttttctggcggaattaaaacagcattg

SEQ ID NO: 111857 - DNA, 1600 bp, Homo sapiens
  Payload ID: 1923
  Gene Symbol: BDKRB2
  Gene Name: bradykinin receptor B2
  Uniprot ID: P30411
  ENST ID: ENST00000539359
  CDS Start-End: 403-1497
actccagctctggcttctgggctccgaggaggggtggggacggtggggacggtggggacatcaggctgccccgcagtaccagggagcgactgaagtgcccatgccgcttgctccggagaaggtgtggcctcactcacatcccactctgagtccaaatgttctctccctggaagatatcaatgtttctgtctgttcgtgaggactccgtgcccaccacggcctctttcaggtgaggtcattgtggttcaaggacgttaagtaacttccccagcgtcacacggcttataagtaaggcagccaggatgtgaacccagtaggactatctggctgcaaagtccccaccctccctcgccatctgtatcctccaatcatcttcagtgctttgctgatagaagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttg

SEQ ID NO: 111858 - DNA, 6845 bp, Homo sapiens
  Payload ID: 1923
  Gene Symbol: BDKRB2
  Gene Name: bradykinin receptor B2
  Uniprot ID: P30411
  ENST ID: ENST00000542454
  CDS Start-End: 3089-4183
agagcggagagcgaaggtggccgcagccttcccggccccacagccagcctggctccagctgggcaggagtgcagagctcagctggaggcggagggggaagtgcccaggaggctgatgacatcactacccagcccttgaaagatgagctgttcccgccgccactccagctctggcttctgggctccgaggaggggtggggacggtggggacggtggggacatcaggctgccccgcagtaccagggagcgactgaagtgcccatgccgcttgctccggagaagcccaggtgtggcctcactcacatcccactctgagtccaaatgttctctccctggaagatatcaatgtttctgtctgttcgtgaggactccgtgcccaccacggcctctttcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaattaataagcagcatctggtgctatactttggtctctagtgagttagctcatgaaagatgacagactctccaagccaggggtatgcaggaaatgggttttctgtagctacagaaatggggttgagggttggaccaaggggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagcatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtcccgtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtatctctcccgtgactcgtagttcagctcttcctccatgagcctgactatcagtggaccttccagaaagagccccttttccttctctcacccacagcacagggcactgggaaaatgcccaatgagtcctgccctctgggttgtgctttggacttttcagtgtgtcttcgcatccactcttcagcttgaatgttgcaacagccatgaaaaaagaaatgcaaagcgattcaggatgagagcaataccctactccaaagaaggcaaaatagaagctcagagaggtcaagcattttgcccaagaccacacagctaggagtggaactcatggctgtccaagccccacgcctctgctgaaggtagagatgaattacagcaacaagtctagaaaggtgcctgccctatggtctgtgagtcttgcctaagaatgaaagaggagccagtgggttaaagatgaggtcaccaacaaacggtggtgttggagtttaccactggttattttaatgggtttgcaagaattgttaattactaatgtttattgagcctagtgcagtgcttggggcattttgcacattgtctctgatccctatcacaaccctgagaggtagtttttttaactcccattttacaggtgaggtcattgtggttcaaggacgttaagtaacttccccagcgtcacacggcttataagtaaggcagccaggatgtgaacccagtaggactatctggctgcaaagtccccaccctccctcgccatctgtatcctccaatcatcttcagtgctttgctgatagaaggtacggaaatacgatgccacagactgtccaggaagacagaaactaggcagatgggctggccatggtctccaagccagactggaatctccaggtctggaatgatatcatttttctcttttaataaattaactcacccaccacacggctttgagaggctcaaaggtgaccaactcccttgggagggccccggttgataaggaaggaatgtgaatcctcccatcacggaagcttcaaggaggtcaagggtccaacacttgagattgttagtgctgttggtggatactggccaaggaaatatcccagtggagcctcgagatgaagaacatgaggcccccgtttagatccaaggatcagagggggctctgtaagacccaggggagtcaggtgcactggagcgcgggctgcagaaaacagcctgagctccacctcggcttctccttgccctggctggttgtccttaacccctgtctccttctggaccagtttttgtccttcccttgtgaccctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccatctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaactggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcata

SEQ ID NO: 111859 - DNA, 4040 bp, Homo sapiens
  Payload ID: 1923
  Gene Symbol: BDKRB2
  Gene Name: bradykinin receptor B2
  Uniprot ID: P30411
  ENST ID: ENST00000554311
  CDS Start-End: 205-1380
gacatcactacccagcccttgaaagatgagctgttcccgccgccactccagctctggcttctgggctccgaggaggggtggggacggtggggacggtggggacatcaggctgccccgcagtaccagggagcgactgaagtgcccatgccgcttgctccggagaagcccaggtgtggcctcactcacatcccactctgagtccaaatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccatctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaactggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgca

SEQ ID NO: 111860 - DNA, 2480 bp, Homo sapiens
  Payload ID: 1924
  Gene Symbol: BRAF
  Gene Name: B-Raf proto-oncogene, serine/threonine kinase
  Uniprot ID: P15056
  ENST ID: ENST00000288602
  CDS Start-End: 62-2362
cgcctcccttccccctccccgcccgacagcggccgctcgggccccggctctcggttataagatggcggcgctgagcggtggcggtggtggcggcgcggagccgggccaggctctgttcaacggggacatggagcccgaggccggcgccggcgccggcgccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagcaacaaaaggaaaataaatgaacatatgtttgcttatatgttaaattgaataaaatactctctttttttttaaggtgaaccaaagaa

SEQ ID NO: 111861 - DNA, 743 bp, Homo sapiens
  Payload ID: 1924
  Gene Symbol: BRAF
  Gene Name: B-Raf proto-oncogene, serine/threonine kinase
  ENST ID: ENST00000479537
  CDS Start-End: 1-309
atccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccaggtgctttgtcctccatgggagtataataaatgatgtggcaagggcttactctccatgagaggaatgtgtgaccaacagaaggataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagcaacaaaaggaaaataaatgaacatatgtttgcttatatgttaaa

SEQ ID NO: 111862 - DNA, 8294 bp, Homo sapiens
  Payload ID: 1924
  Gene Symbol: BRAF
  Gene Name: B-Raf proto-oncogene, serine/threonine kinase
  ENST ID: ENST00000496384
  CDS Start-End: 1-1127
gatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggagaatttgcagccttcaagtagccaccatcatggcagcatctgctcttatttcttaagtcttgtgttcgtacaatttgttaacatcaaaacacagttctgttcctcaaatctttttttaaagatacaaaatttccaatgcataagctgatgtggaacagaatggaatttcccatccaacaaaagaggaaagaatgttttaggaaccagaattctctgctgccagtgtttcttcaacaaaaataccacgagcatacaagtctgcccagtcccaggaagaaagaggagagaccctgaattctgaccttttgatggtcaggcatgatggaaagaaactgctgctacagcttgggagatttgctatggaaagtctgccagtcaactttgcccttctaaccaccagatcaatttgtggctgatcatctgatggggcagtttcaatcaccaagcatcgttctctttcctgttctggaattttgttttggagctctttcccctagtgaccaccagttagtttctgagggatggaacaaaaatgcagcttgccctttctatgtggtgcgtgttcaggccttgacagattttatcaaaaggaaactattttatttaaatggaggctgagtggtgagtagatgtgtcttggtatggaggaaaagggcatgctgcatcttcttcctgacctccggggtctctggccttttgtttccttgctcactgaggggtctgtctaaccaagcaggctagatagtgctggcacacattgccttctttctcattgggtccagcaatgaagataagtgtttgggttttttttttttcctccacaatgtagcaaattctcaggaaatacagtttatatcttcctcctatgctcttccagtcaccaactacttatgcggctactttgtccagggcacaaaatgccgtggcagtatctaactaaacccccacaaaactgcttaataacagttttgaatgtgagaaatttagataatttaaatataaggtacaggttttaatttctgagtttcttcttttctatttttattaaaaagaaaataattttcagatttaattgaattggaaaaaaacaatacttcccaccagaattatatatcctgaaaattgtatttttgttatataaacaacttttaagaaagatcattatccttttctctacctaaatatgaggagtcttagcataatgacaaatatttataatttttcaattaatggtacttgctggatccacactaacatctttgctaataatctcattgtttcttccaactgattcctaacactatatcccacatcttctttctagtcttttatctagaatatgcaacctaaaataaaaatggtggcgtctccattcattctccttcttccttttttcccaagcctggtcttcaaaaggttgggcaatttggcagctgaattcccagacagagaatagagcaattttagggatattaggactgagggagggtgtgggaaagctgtcatcagttgtttttatagaaagaactggcattcattaagaacctaaatcttatctttgcacaaatggaaaatataacctagttatagcttcctttggcctttattaaagggtaatatcaatcacagtcatagcaaagaaagcggatgtattaatggcaaattaatggaaaacctcccttatcaggaatctagactcagaatttaggaacacaaatcaaatcagaccaaccaagctatagccaaggacttgaaagaaattaaacaagacccagaataaatcaaggaattagaaattgttatttaaaaatttcagattgtaactccaggccctgctgtctatattgcagccactaaaagctcactaccattagatttttgctaacatacatgtattcagaagaaagcctattgaaattttcattgtcttgtaaaaggttgtcctagtaaaatggaaaagatccttaagttattaatcagtttgaaaagcaaatttgtttttaagttttacatcagcagggcagtgtcttacaaaattcagaaattgcaaaggtggaaataattcacgctgatttgaagaacatcttctgtgcaataatactgcctctcttgaaaagcattggctgttttttctttttaaatatatctctagatgcttttaaatgtggctgtgttccctttaccaagattggcttcaagtttccgcaggtagagagacctgggcttgaacaagaggatgtgtttcatgtcctgctgaggaggtagaacatgtgcagcctgggtccgggactgcctccgtggggcaggggcaggggcggtaccattagggaggaagcttagcatttcagtttcttaaacaatattcagggtgatacactttttcttcccttgcattttagaataggctggtatctcatttgaacgggggagcagacttgatctcaaatgaagctgtgcccaggagccaggcttagcatattgagatttttatagataccttaaaaaataaaatatttaaacctctcttttcttcctttttctatgaaataggttttttctctagtttacaaatgacatgaaaataggttttatttgtgttttatctgctttattttttgatgcttagacaacagttagacttactgagctcctaaaaaaacgaggaagaagtccttatttgtgaaaagcactttatgagtaattgtatagacagtatgtggctgcgtcactgatcatcttgtaagggtgtaacagtcttgtctgtaaagtggctgcagtgccttctgtagtgtgttttatttttggtagggagaggtgaagccttctgaaaaatttgagagcaactacagaggattgtttgtaactgtgtagtattcctgatggacttttttcatcgttagagtcaaggacctagacttttgccactgaaataatattgaccaaaaaaatagtttataaaagggatttgtgaatagaaaattcagtgtgatcatttgttgttaatgtgcaccttaaaagaagattctgtctagctgtcaaattctggttcccgaatatctcacccctgattgtatttgagatctagtagggcatactggggcattttagaagataaaatcccatacaaatgatatatgctatatttatgttggtgttggagaagaaagagcagtatataaagaaataattcaagactgcagcactgtcaacctgaaactttgtaaatatttcctagcttctggtttggtgcggtgacagcactttcatcacaggatgttaccttgtattcaccaggcggagtgcgagctgctgcacatcctcctcagatctcacctgtccccactgtacatccacccgccagctgcttgcaaacctcatctctagctttagttcgaaaccacattgcagggttcaggtgacctctacaaaaaactacctcttcagaatgaggtaatgaatagttatttattttaaaatatgaaaagtcaggagctctagaacatgacgatgatttaagattttaacttttttgtgtacttgtatttgagcactctcattttgtcctaaagggcattatacatttaagcagtaatactgtaaaaaaatgtgttgctcggaatatctgaatgttgttgaaagtggtgccagaaccggtttaggggtacgtttcagaatcttaaccttgagtcaattgcatgaaattaaatagctgtggtatcacttcactaacagtgatgtaattttaattttcagtaggcttggcatgacagtacatcctcataatgagtttgctgcagctttgtcacatgcacaggcattcatagaaagaccacccagctaagagggtagaatgattactctttttgcaagattctcttctttgtccaagttggcattgttagtgctaggaataccagcaccttgagacgagcagattccaaccattaggctataaacaccatagccagagatggaaggtttactgtgagtatgaacagcaaatagcttacaggtcatgagttgaaatggtgtaggtgaggctctagaaaaataccttgacaatttgccaaatgatcttactgtgccttcatgatgcaataaaaaagctaacattttagcagaaatcagtgatttgtgaagagagcagccactctggtttaactcagctgtgttaataatttttagagtgcaatttagactgcataggtaaatgcactaaagagtttatagccaaaatcacatttaacaatgagaaaacacacaggtaaattttcagtgaacaaaattatttttttaaagcacataatccctagtatagtcagatatatttatcacatagagcaactaggttgcaaatatagttcagtgacatttctagagaaactttttctactcccataggctcttcaaagcatggaacttttatacaacagaaatgttgacagaaattgctgtagtttagggttgaagtactgtatgatgggcagcaatcatgtattaacttagaaggggaaattgaaatataggaccgaatttggttttatcagtttccagagtactgctgccaacctagacactgatttttcagagtttgaaatgtaaatttcttcccgggacttgattgcacatgaagctggactgcgttagtcatcctgtcccaaagcgctgtgggggccagggtggaggtctcaaggcatcctttatgacctggccattggatgtaaaagaaaacatattccatgctgtggttcttgtatcttgtttcattcctcaccattgaaagagaaagtccatgtattgtctccagcacatccttgaaatgttatactgggatggattactgatgcccatcggtagttgagccccagaagagggtagtagcatctctgcctcaggtgatgatttgtagcttggccagaggagagcggagtcaccagtatatctgtggtccatgttgctagctctggtaaaattaaaaatactggtaagatgtttgttttattagtacactagacagtaagctctgttttgttgttttcaaataacctattttcacttttgtttgggcaaagacatttaaattgaaattcaattctaatttttgttaattgtggaaagggtaattaacagttcctatcaggtatttttaatgtggaaaaggacagaaacccaactcctaaaatcttaaattaaggtaacagtgctttaaaaaaaaaaaatgcatggggcaattagtcggcaactcaatgagtgactaaagtacttttatttaacatccacaacttcaactgttaagttttattaattactaaatcagctttattaaaatgttgacatttatttagctattttgaataattatagtgacttgacgagtgtgtatgaggacacagccaatgtaagccagtgtatccattttttagaggtgcatttttttttaaagaattctgtagatagaagtgctctgaaaacaactaaaatatgtttattcatggtagtatcaaaaaatgtttgtacaaaccatctgcttctcccggccagccgagttcattctccagcaccgtgaccgctggttctcatgtacagcacatatgcgggagagttggcagaaaatttgtgaagagatgccgcaaaggaagggtctgttgacgggtgggattgggggttttgatgaagttgcttagtcctggttttgttttgaaaattactgcgttgcatttttgtgttaagtttttgaacccacgtgtgttttggtggagtatgagttggaagtcactgcaaactagcataaacaacaaagctcacagagtaggcacagatgtagagaacagagaccaaaatggggtgaggtggcagtaaatctaggatagggaaaaattaatgtgagggtgggaaataaactgtaattacctgaaatcaaatgtaagagtgcaataagtatgctttttattctaagctgtgaacggtttttttaagaatcattccttcctaatacatttgtgtatgttccatagctgattaaaaccagctatatcaacatataatgcctttttattcatgttaatgaccaacgtaagtggctagcctttatgtcttatttatcttcatgttatgttagtttacatacaggggtgtatgtctctgtgctgtccccttctcctgccttcattttaaaatgcatccatgggtcctccgtgtttcctttggccatgccacatatatagactcagtttggccttcatgatatcgcctgatttttgaggactgtatcacagtgatatgtatttgtggtaatctcatttgttggttgtacatctgatcctttcctcaacatggcaattgctgcctttcctaagataggatcatacaactgatcaggggattgaatttgatcattcatcaacatgtgtctctgaattttattcagtagttgtcattgctctttggtttagaccaagaaaaaggaaatccccccttttcatgtattccttggtttgaggacatgactcctgtaagggagaggaaagggagatgcttcctgtttgaactgcagtgaattcacggttcctgtttcaccactccaaaccttatggcgactcacacacacattcctcttttctgttactgccaaaggttcgggtttagtacacttcagttccactcaagcattgaaaaggttctcgtggagtctggggcgtgcccagtgaaaagatggggactttttaattgtccacagacctctctatacctgctttgcaaaaattacaatggagtaactatttttaaagcttatttttcaattcataaaaaagacatttattttcagtcaaatggatgatgtctccctcttttcccctattctcaatgtttgcttgaatcttttattattttttttaattctcccccatacccacttcctgatactttggttctctttcctgctcaggtcccttcatttgtactttggagtttttctcatgtaaatttgtataacagaaaatattgttcagtttggatagaaagcatggagaataaaaaaagatagctgaaattcagattgaagaaatttatttctgtgtaaagttatttaaaaactgtattatataaaaggcaaaaaaagttctatgtacttgatgtgaatatgcgaatactgctataataaagattgactgcatggagaagtcttca

SEQ ID NO: 111863 - DNA, 2336 bp, Homo sapiens
  Payload ID: 1924
  Gene Symbol: BRAF
  Gene Name: B-Raf proto-oncogene, serine/threonine kinase
  ENST ID: ENST00000497784
  CDS Start-End: 1-585
caggctctgttcaacggggacatggagcccgaggccggcgccggcgccggcgccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatgggtcttttctggagctgacttgaagaaaagagtacatctctttaccctgctgtttgtccaagagtgatacatttatttgggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactga

SEQ ID NO: 111864 - DNA, 1878 bp, Homo sapiens
  Payload ID: 1925
  Gene Symbol: BASP1
  Gene Name: brain abundant, membrane attached signal protein 1
  Uniprot ID: P80723
  ENST ID: ENST00000322611
  CDS Start-End: 261-944
gggcactgggcaggaaggggagggggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaagtctgcgttcattgcagttccagtttctcttccattctgtgtcacagacaccaacacaccactcattggaaaatggaaaaaaaaaacaaaaaaaaaacaaaaaaatgtacaatggatgcattgaaattatatgtaattgtataaatggtgcaacagtaataaagttaaacaattaaaaagaa

SEQ ID NO: 111865 - DNA, 401 bp, Homo sapiens
  Payload ID: 1925
  Gene Symbol: BASP1
  Gene Name: brain abundant, membrane attached signal protein 1
  ENST ID: ENST00000606445
  CDS Start-End: 265-401
tgtttggcatcccactgaccccacatctgtttcgctgctaatgctctgctgccagaactatccaagctgcctccctctgggcccagggactattgctgaagagatgacatctctgtatgttacccaggctggactggaactctgggctcaagccatcctcctgcctcacctcctgaagtgttgggattacaggaaagggtcccaatccagaccccaagggaggattcttggatctcatgcaagaaagaattcaggaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgc

SEQ ID NO: 111866 - DNA, 1711 bp, Homo sapiens
  Payload ID: 1925
  Gene Symbol: BASP1
  Gene Name: brain abundant, membrane attached signal protein 1
  Uniprot ID: P80723
  ENST ID: ENST00000616743
  CDS Start-End: 85-768
gcgcaactcgtttgcagcggcgcagcccagacgcgcctgcagctggggctcaccccaacctcgctgccagccgagaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaagtctgcgttcattgcagttccagtttctcttccattctgtgtcacagacaccaacacaccactcattggaaaatggaaaaaaaaaacaaaaaaaaaacaaaaaaatgtacaatggatgcattgaaattatatgtaattgtataaatggtgcaacagtaataaagttaaacaattaaaaagaagtaataaag

SEQ ID NO: 111867 - DNA, 801 bp, Homo sapiens
  Payload ID: 1926
  Gene Symbol: BAALC
  Gene Name: brain and acute leukemia, cytoplasmic
  Uniprot ID: Q8WXS3
  ENST ID: ENST00000297574
  CDS Start-End: 140-682
gcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcggttctggaggctgagaagtccaagatcaaggcaccaacagattcagtgtctgatgaaggcttgttctctgcttcaaagatggcacctcttgctgtgttctcacatggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccc

SEQ ID NO: 111868 - DNA, 243 bp, Homo sapiens
  Payload ID: 1926
  Gene Symbol: BAALC
  Gene Name: brain and acute leukemia, cytoplasmic
  Uniprot ID: Q8WXS3
  ENST ID: ENST00000306391
  CDS Start-End: 1-243
atgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcggcccattaccctcttgcctttgcacttgcctggagagacaacagtttaggggctctgctggttcaagaaggactgtgcaggtag

SEQ ID NO: 111869 - DNA, 2831 bp, Homo sapiens
  Payload ID: 1926
  Gene Symbol: BAALC
  Gene Name: brain and acute leukemia, cytoplasmic
  Uniprot ID: Q8WXS3
  ENST ID: ENST00000309982
  CDS Start-End: 189-626
gctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaataggcagcctattggtgttatgtttatgtaacatagtccagagaactgacatgcaggtcaaaagtcagatacgcaacctccttatctgctaactctgttattcttcaaacacaagtgggtagtgtcatttttccttccttccttccattggcagattgtatatttattcacaaaacattaaatgtccatcctgtgccaggtactatgcagatgttgagggatttggggtctggttagtcgtgactatctatcctgaatctaacagtgacttcataactaggagactgaattagacccttaaggtatagtgtgtgttgcaaatcactctgcaatggaaacttttatattcagggtaggtttgtgtcttaaactaggtgttctaatcaatgtacaagactttaccatacacgcaactatagtttttctaaaccttcatcattttgtgattctttgagaaagggcttttaggaactttatgttctaaaaaatgtttttaacaataataagataaaagaaaaacctgtgattcatatgtccccactggcattactcagcaggagcccccagctgccaaaggttggcagtgatcctgcaagttcaagggctctttctccctggggatgtgctttgtggcttctctttacagctttgtttctgcatcagttcactgctgcatgttgtttggaatttatcaccttaagaaagtgtctctgttttatatagaaacactttctcacttacaggggagaaggaaatgcagggcacatgatctggccctccccagaacaatctggatttcacggagacagcaaccagaagttaaaccatgtgactaaaaatgcatctggctactttttcatgtatgtatgagacagaaactaatccttactatcctattaggataccacttttcattgcaaagtttgtgtcaataaagtcattaattttaaacat

SEQ ID NO: 111870 - DNA, 222 bp, Homo sapiens
  Payload ID: 1926
  Gene Symbol: BAALC
  Gene Name: brain and acute leukemia, cytoplasmic
  Uniprot ID: Q8WXS3
  ENST ID: ENST00000330955
  CDS Start-End: 1-222
atgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcggggtgccttgaggaacattaccatctgactgccctacagaaagttgggcatcccaaccattga

SEQ ID NO: 111871 - DNA, 2662 bp, Homo sapiens
  Payload ID: 1926
  Gene Symbol: BAALC
  Gene Name: brain and acute leukemia, cytoplasmic
  Uniprot ID: Q8WXS3
  ENST ID: ENST00000438105
  CDS Start-End: 186-350
gggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaataggcagcctattggtgttatgtttatgtaacatagtccagagaactgacatgcaggtcaaaagtcagatacgcaacctccttatctgctaactctgttattcttcaaacacaagtgggtagtgtcatttttccttccttccttccattggcagattgtatatttattcacaaaacattaaatgtccatcctgtgccaggtactatgcagatgttgagggatttggggtctggttagtcgtgactatctatcctgaatctaacagtgacttcataactaggagactgaattagacccttaaggtatagtgtgtgttgcaaatcactctgcaatggaaacttttatattcagggtaggtttgtgtcttaaactaggtgttctaatcaatgtacaagactttaccatacacgcaactatagtttttctaaaccttcatcattttgtgattctttgagaaagggcttttaggaactttatgttctaaaaaatgtttttaacaataataagataaaagaaaaacctgtgattcatatgtccccactggcattactcagcaggagcccccagctgccaaaggttggcagtgatcctgcaagttcaagggctctttctccctggggatgtgctttgtggcttctctttacagctttgtttctgcatcagttcactgctgcatgttgtttggaatttatcaccttaagaaagtgtctctgttttatatagaaacactttctcacttacaggggagaaggaaatgcagggcacatgatctggccctccccagaacaatctggatttcacggagacagcaaccagaagttaaaccatgtgactaaaaatgcatctggctactttttcatgtatgtatgagacagaaactaatccttactatcctattaggataccacttttcattgcaaagtttgtgtcaataaagtcattaattttaaacata

SEQ ID NO: 111872 - DNA, 1681 bp, Homo sapiens
  Payload ID: 1927
  Gene Symbol: BRE
  Gene Name: brain and reproductive organ-expressed (TNFRSF1A modulator)
  Uniprot ID: Q9NXR7
  ENST ID: ENST00000342045
  CDS Start-End: 142-1293
gggtacctgtaccccacgtagtcgccggttaccgatcggactaagttccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 111873 - DNA, 1852 bp, Homo sapiens
  Payload ID: 1927
  Gene Symbol: BRE
  Gene Name: brain and reproductive organ-expressed (TNFRSF1A modulator)
  Uniprot ID: Q9NXR7
  ENST ID: ENST00000344773
  CDS Start-End: 139-1386
gagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 111874 - DNA, 1686 bp, Homo sapiens
  Payload ID: 1927
  Gene Symbol: BRE
  Gene Name: brain and reproductive organ-expressed (TNFRSF1A modulator)
  Uniprot ID: Q9NXR7
  ENST ID: ENST00000361704
  CDS Start-End: 75-1205
ggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 111875 - DNA, 1657 bp, Homo sapiens
  Payload ID: 1927
  Gene Symbol: BRE
  Gene Name: brain and reproductive organ-expressed (TNFRSF1A modulator)
  Uniprot ID: Q9NXR7
  ENST ID: ENST00000379624
  CDS Start-End: 118-1269
gcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 111876 - DNA, 865 bp, Homo sapiens
  Payload ID: 1927
  Gene Symbol: BRE
  Gene Name: brain and reproductive organ-expressed (TNFRSF1A modulator)
  ENST ID: ENST00000379629
  CDS Start-End: 13-865
agtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcagttaagcctgagcccttgccacacggatttccttctcacccgcttcctccccgcaccactctggggatcagaagtatcagtgccaagtggtccctttcatctcctcataattcttccccagccacttagtgggttagtcaggccctgccttctcttcagccagccctgcagtc

SEQ ID NO: 111877 - DNA, 1752 bp, Homo sapiens
  Payload ID: 1927
  Gene Symbol: BRE
  Gene Name: brain and reproductive organ-expressed (TNFRSF1A modulator)
  Uniprot ID: Q9NXR7
  ENST ID: ENST00000379632
  CDS Start-End: 141-1271
ggtacctgtaccccacgtagtcgccggttaccgatcggactaagttccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaa

SEQ ID NO: 111878 - DNA, 874 bp, Homo sapiens
  Payload ID: 1927
  Gene Symbol: BRE
  Gene Name: brain and reproductive organ-expressed (TNFRSF1A modulator)
  ENST ID: ENST00000436924
  CDS Start-End: 415-874
ctcagcagccgggccaagaaaggtctttgggggcgcaagtctttggagggcaggtctttggggagcgctttgagtaatattagagctttcactaaaccctggcctattacgtcccctcccctgagatttacctttatatactcaagttctttcatgccaggaaggtaggctgaaggcttcgaaaacctgcagctcatacccaaagctagcactgtctatccctggagacccagcgcccaaaagctccactgggcgcatagcgcacggcacgcctcctcccccgagccgcagactgagtaactggccccggactaacctgaccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagaga

SEQ ID NO: 111879 - DNA, 500 bp, Homo sapiens
  Payload ID: 1927
  Gene Symbol: BRE
  Gene Name: brain and reproductive organ-expressed (TNFRSF1A modulator)
  ENST ID: ENST00000604932
  CDS Start-End: 1-500
gtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggtaaggatttttgagaatggaaaaaaagatgacttcatccataataaaataatcaattcatatgtcca

SEQ ID NO: 111880 - DNA, 668 bp, Homo sapiens
  Payload ID: 1928
  Gene Symbol: BEX2
  Gene Name: brain expressed X-linked 2
  Uniprot ID: Q9BXY8
  ENST ID: ENST00000372674
  CDS Start-End: 194-580
cgtgatcggccaacactgagtcttacctcgttgtggcgtcagaaccgccgtcgctcgctcccttctcggcagtggtacctgttcccggtgtccctgaggacgtgcgggccaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttga

SEQ ID NO: 111881 - DNA, 899 bp, Homo sapiens
  Payload ID: 1928
  Gene Symbol: BEX2
  Gene Name: brain expressed X-linked 2
  Uniprot ID: Q9BXY8
  ENST ID: ENST00000372677
  CDS Start-End: 269-655
gggacgggggcggagcctctggcgatgacaacagccacacgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagca

SEQ ID NO: 111882 - DNA, 736 bp, Homo sapiens
  Payload ID: 1928
  Gene Symbol: BEX2
  Gene Name: brain expressed X-linked 2
  ENST ID: ENST00000449185
  CDS Start-End: 432-736
tggtacctgttcccggtgtccctgaggacgtgcgggccaggtacggccccgaaagtaggaagcggagggggagcaggtaagggacccggagggggtccctggggttggtgtgggggagcagccccggcctgcggatgccccatccccgggcagcagcgcggagacgcagccggtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgctccgcccttcttgatgcagaaaatggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaa

SEQ ID NO: 111883 - DNA, 1077 bp, Homo sapiens
  Payload ID: 1928
  Gene Symbol: BEX2
  Gene Name: brain expressed X-linked 2
  Uniprot ID: Q9BXY8
  ENST ID: ENST00000536889
  CDS Start-End: 359-841
gctcgctcccttctcggcagtggtacctgttcccggtgtccctgaggacgtgcgggccaggtacggccccgaaagtaggaagcggagggggagcaggtaagggacccggagggggtccctggggttggtgtgggggagcagccccggcctgcggatgccccatccccgggcagcagcgcggagacgcagccggtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgctccgcccttcttgatgcagaaaatggtggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagtttt

SEQ ID NO: 111884 - DNA, 2160 bp, Homo sapiens
  Payload ID: 1929
  Gene Symbol: BEAN1
  Gene Name: brain expressed, associated with NEDD4, 1
  Uniprot ID: Q3B7T3
  ENST ID: ENST00000299694
  CDS Start-End: 364-816
ctggagccgaagctggagccggcactgcggcgcacggagcggagcgctgcagccaagccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtgagggacccagccagccgggtcctgctggtccctacaggctgaaccacattctttaggcacacaaaggcgtgcacacacacacagagatgcacacgtgactcataacacacacatagaccaaacttgtatacacacagacatctacactgacataccccatgtacacacacagatctagacgtgctccacatatgtgtgaatatgcgcacatacaggcctaccacaaacacaaaacccacctgcaaaggtttcacggaacgtggagctctcctggcctcccgtccctcctcccggcctgtttgttgtgcctctgtagagagcgcttcggagagagaggcgaagtaggaagtgggattttctcttccctctcctgggcccgtttgcccctaccctcgcccagcaagctgcgcccaaattctattctgcctctggaaactgctggaccatccaaggtcagctgcctgccctgacccctaccccagggccagcttgtcctcctgggaggcgggacaggccccagtgaggttccgttgtgcgctgtgcctatctctcgattccagggcagatgagccacaacatcaccaccctgccacttacaaggtgggggacctgggtctggggtctcaggcgcaaactggaggccctcacagcccactaggccccctcccaaccccagtaccctcagtccctcagtcaggtggtgctagtagagctatctctgacgctgcaggccccaggtagatgggcagggccctccgtgggtgtgcagcggcggttccctcatcagtccagccactgcccaggactaagggtcttcaaggaagatgaggccattgcccttctccaggtggcttcaccacagtgctgcctgggcacctctctgaggcagagaagtggcccctccctcagtccctgcctggccgaccactgtggcctgcacgcgaatgggtcagagccagaccccggagctggtgctgtccttctaggtggctgctcatagctggggatggtgagtggctgtgttctggccttgcccacgtgggtgtttgcagagacaaaatgaaggggatatgctccccataaataccaccttgccaccacaagaggaccagaaggctactcagccttgctgccacagaaggggatttgtagggtcagcctggctgcagaaaggctggctcagatcttgaccaagaaaccccagcgatttccatcaaagaccacgcaggtaacagaggtgattcctgaagacccagcccacagagggtggcagccaagcatctctgagcagtgtccctgctagcatcgccagcggccatcactctgcctccctcccacctcttgt

SEQ ID NO: 111885 - DNA, 1988 bp, Homo sapiens
  Payload ID: 1929
  Gene Symbol: BEAN1
  Gene Name: brain expressed, associated with NEDD4, 1
  Uniprot ID: Q3B7T3
  ENST ID: ENST00000536005
  CDS Start-End: 218-997
gacgcccgagcccgagcgcagtggcctccgagcgggaaccggactgggagccggagccggggcgggaaccggagctggagccgaagctggagccggcactgcggcgcacggagcggagcgctgcagccaagccgagtgagtggaggggccttccctgcgagaagtcagagctgtgcccgtgggcaggctggctccgctgttctgctccaaggattacatgtccttcaaacgtccctgccccttagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtgagggacccagccagccgggtcctgctggtccctacaggctgaaccacattctttaggcacacaaaggcgtgcacacacacacagagatgcacacgtgactcataacacacacatagaccaaacttgtatacacacagacatctacactgacataccccatgtacacacacagatctagacgtgctccacatatgtgtgaatatgcgcacatacaggcctaccacaaacacaaaacccacctgcaaaggtttcacggaacgtggagctctcctggcctcccgtccctcctcccggcctgtttgttgtgcctctgtagagagcgcttcggagagagaggcgaagtaggaagtgggattttctcttccctctcctgggcccgtttgcccctaccctcgcccagcaagctgcgcccaaattctattctgcctctggaaactgctggaccatccaaggtcagctgcctgccctgacccctaccccagggccagcttgtcctcctgggaggcgggacaggccccagtgaggttccgttgtgcgctgtgcctatctctcgattccagggcagatgagccacaacatcaccaccctgccacttacaaggtgggggacctgggtctggggtctcaggcgcaaactggaggccctcacagcccactaggccccctcccaaccccagtaccctcagtccctcagtcaggtggtgctagtagagctatctctgacgctgcaggccccaggtagatgggcagggccctccgtgggtgtgcagcggcggttccctcatcagtccagccactgcccaggactaagggtcttcaaggaagatgaggccattgcccttctccaggtggcttcaccacagtgctgcctgggcacctctctgaggcagagaagtggcccctccctcagtccctgcctggccgaccactgtggcctgcacgcgaatgggtcagagccagaccccggagctggtgctgtccttctaggtggct

SEQ ID NO: 111886 - DNA, 1078 bp, Homo sapiens
  Payload ID: 1929
  Gene Symbol: BEAN1
  Gene Name: brain expressed, associated with NEDD4, 1
  Uniprot ID: Q3B7T3
  ENST ID: ENST00000561796
  CDS Start-End: 364-990
ctggagccgaagctggagccggcactgcggcgcacggagcggagcgctgcagccaagccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggggtctcactcagtcgcctacgctggagtgcaatgatgtacactgggagctttacctactgggtgcgatctatgctttccagacacaaactggacgccatcctgggcaggctgggctacacggccaccttggagtctgagttctcactggtccaggccatcagcaaagagaatgtcaagcagatggtgttcaagatcttcctggtgagggtctcatgtgaagccgttctcagaaccgcgggcacacggatgcttgagccgggcacagagaaactcgctaggacccacagcaggcacagctcagagaaaaggctggtgaagccctgcagctgcctcgagggggttcagccaggcccaggttccgggggaccacagcaaggtccctcagaaggggtggggtccgagacggccctggcagagggcactgctggccagagatctctgcccatggctctgagcccatctgaggtctcaacagcccccaacagcctccccagtggctctccagtcctctagggcccccagtgccatggcagcacatgcctggacagtgaggaggtcctgccttgcttcagtgaccctgtcttacactggatgccctggt

SEQ ID NO: 111887 - DNA, 2929 bp, Homo sapiens
  Payload ID: 1929
  Gene Symbol: BEAN1
  Gene Name: brain expressed, associated with NEDD4, 1
  ENST ID: ENST00000564819
  CDS Start-End: 191-409
catcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggacagggtctcactcagtcgcctacgctggagtgcaatggtatgaacatagctcactgtagccttgaactcctgggctcaagtgatcctcccacctcagcctcctaagcagctgggactacaggcatgcaccaccatacccagctaatttttgattttgaatttttgtaaacacagggtctcactatgttgcccaggctagttgaaactcctggtctcaagcgatcctctcacctcagcctcccgagtagggtttataccttctgaaacttgtaagaaaaggaaacactaaatagcaacaaaatgaaaatacacctccggctagcaatctctacccattcattacctctcaagattaagcaccattgaagccttgtcattttcctgttgatgtggatatttggatagtcagtgccttacaggagttgcttttttttttttaacctcactgaaacttggcatcatttctctgagacatggctggtgtaacgtcatgaggatgggccatcaacttcaggacctgactctaggaacttcagagactacacgttttactctaacaggagttggcttgtagcaccctgatggcttgtaccaccaggaaagagaggaaagtggcaatgaaactgaaatgagctgttgtctcaccctctgcaggaattcccctcttcctttccatgccctccacaacaccatggcttgggctattgatctcttagcggacagagcctgggccccttcctctgtcacatttccctcccaccagaactccaatagagcccactaacatagtcctagatgcccccaagtgccttgaaagtggggtgcaatccaaaattcgaatagtccattaatatagtcttagaccccaagtgccttgaaagtggggtgcaatcctgaaggagggtgcagcggggggaaagaccacgagataggctcatccttctggttctccagcccacgtccctgctggacaggccaaggctggctctgctgcgcctatcacccccaccctgagcccacactgccacctgccggctcgctgctgccactgctcaaagtgaacaagtcaggccctgaagaatgaggaagcccctcctctcaccttgaaacacaatacccaccagcactcataattgcagacaaaacccgtcattttaaccctgggcttttcttccacccttgagatgttctatgaggttgaacccattcaagtattccatttttggggctcacccccgccccgccagcatcactctctggacaaagcctgacacttatgtccccctctctgtaagcaaaataatcattttgcatgccctctgttctgaacatcactaggcatggctctggtgccacctcagtgctctggggctccacctcctgggaatgaatgcagaaacttccacagtgatggtgtccagccatgtgctgcccccaaccgaaaccaccccacaccgacacccagctcccaccacaaagacttaggatcccacaggcctttgggactgtcacgctcttggcttttcctgctcctccatccacgacatgccctatgctgtggtgtgtcacatatggcaccacattcaaggtcctttgcacattcctaaggagatgccgcctgtctgtgccaggggccaaggagaacaccccaggtacctgggctcatcagaggcccaaggagatggaaggtgaagctgcatcacaggacgatggagacaggggccccagggccagaccctgggatgaggatgtgggtgagagtttggttagggaagtgttcccaggagtaccagatggagtgaggcaggaaacaagaaaggcaaggaagccagtgagggggtcaccaagcaggtcaccactgcaggccactgagcgcagtcccactggtgactctgagacacagagtagaacgcacctcaaagtgacgcccgccctcaggtgggagagacgggttgtttgtaccctgatgctcagcagacatttttggaggctgccctttggagaatgttcattcctgccccttgtggaggccaaatgggctcctctggccagaaaaaagtcttcaggggagtcaccgtgctggcgatgacgccatcgtgatagtccacaagagccatcattgggtccccgtgtatgggtgtggtgaggtcccaggtctctgcaaagggctccagcagctgctgccacacacaagcaacaggcatcgcccagaagagggcggaaggagggttgatacagagtaaggctgttcacagccaccacgaggaacatccattgtcacactggccaagcccacatgcacatacacacactggggcccctcccaagttcctagagatacccctggcacacactcacatgtagcatccctcagctccacctcctgtggtttcgtggacatttgctcagacagctttggtgcacacacactagtgcccttctcacttagagcttgtgcacgtacacacttggtgttgcatactccagtgccactgacactcccactcagctgttcctatccatgcccacctgcatgtccaggctcttggcatgagcggtggagagacagtaagcttcatcgtctgaggaagtgaatcttctgtcctggtctctgctttgcttcac

SEQ ID NO: 111888 - DNA, 2469 bp, Homo sapiens
  Payload ID: 1929
  Gene Symbol: BEAN1
  Gene Name: brain expressed, associated with NEDD4, 1
  Uniprot ID: Q3B7T3
  ENST ID: ENST00000562849
  CDS Start-End: 398-850
ggactgggagccggagccggggcgggaaccggagctggagccgaagctggagccggcactgcggcgcacggagcggagcgctgcagccaagccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtgagggacccagccagccgggtcctgctggtccctacaggctgaaccacattctttaggcacacaaaggcgtgcacacacacacagagatgcacacgtgactcataacacacacatagaccaaacttgtatacacacagacatctacactgacataccccatgtacacacacagatctagacgtgctccacatatgtgtgaatatgcgcacatacaggccccagtgaggttccgttgtgcgctgtgcctatctctcgattccagggcagatgagccacaacatcaccaccctgccacttacaaggtgggggacctgggtctggggtctcaggcgcaaactggaggccctcacagcccactaggccccctcccaaccccagtaccctcagtccctcagtcaggtggtgctagtagagctatctctgacgctgcaggccccaggtagatgggcagggccctccgtgggtgtgcagcggcggttccctcatcagtccagccactgcccaggactaagggtcttcaaggaagatgaggccattgcccttctccaggtggcttcaccacagtgctgcctgggcacctctctgaggcagagaagtggcccctccctcagtccctgcctggccgaccactgtggcctgcacgcgaatgggtcagagccagaccccggagctggtgctgtccttctaggtggctgctcatagctggggatggtgagtggctgtgttctggccttgcccacgtgggtgtttgcagagacaaaatgaaggggatatgctccccataaataccaccttgccaccacaagaggaccagaaggctactcagccttgctgccacagaaggggatttgtagggtcagcctggctgcagaaaggctggctcagatcttgaccaagaaaccccagcgatttccatcaaagaccacgcaggtaacagaggtgattcctgaagacccagcccacagagggtggcagccaagcatctctgagcagtgtccctgctagcatcgccagcggccatcactctgcctccctcccacctcttgtccctcgtcgttaaaaaacagcaccctatcctgcttccccacatttctgttcctccaatgaagggctaagactatttagtaatctctttcttaagcagaggagtggcaaggatggcaatcttgaattttattttctgtagagatagcatttcttctggtgcggagctgaaaggaatccacccagaagttctgtagcatcctgcgtgcagcctcctggagccccagactccatctgggggagggacttgtttacaagcagttctgaccaccttagtggtgtactgttttctaggcaaaaaatatctgtctgttgtactgtatagcctttaaaatgcagtccaggaatgagactcttttaagaaacacatcctgcttctgcaattccagagagtgctgggggaaaaaaagggataaaaattcctacctactcatcagtgtttgaaagatggagctgaatagcttttcttgttcctggactaggcaatgaataagcaacaatgtatcttttctgtgttcaaaataaatacataatatcaataaaatgtagcaagaagtaacactttcagagagtgca

SEQ ID NO: 111889 - DNA, 644 bp, Homo sapiens
  Payload ID: 1929
  Gene Symbol: BEAN1
  Gene Name: brain expressed, associated with NEDD4, 1
  ENST ID: ENST00000562146
  CDS Start-End: 1-248
cacccttggacatcagctctgacggggacgtggatgccacggtgctcagggagctgtacccagattctccaccaggatgtacactgggagctttacctactgggtgcgatctatgctttccagacacaaactggacgccatcctgggcaggctgggctacacggccaccttggagtctgagttctcactggtccaggccatcagcaaagagaatgtcaagcagatggtgttcaagatcttcctggtgagggtctcatgtgaagccgttctcagaaccgcgggcacacggatgcttgagccgggcacagagaaactcgctaggacccacagcaggcacagctcagagaaaaggctggtgaagccctgcagctgcctcgagggggttcagccaggcccaggttccgggggaccacagcaaggtccctcagaaggggtggggtccgagacggccctggcagagggcactgctggccagagatctctgcccatggctctgagcccatctgaggtctcaacagcccccaacagcctccccagtggctctccagtcctctagggcccccagtgccatggcagcacatgcctggacagtgaggaggtcctgccttgcttcagtgaccctgtcttacactggatgccctggt

SEQ ID NO: 111890 - DNA, 437 bp, Homo sapiens
  Payload ID: 1929
  Gene Symbol: BEAN1
  Gene Name: brain expressed, associated with NEDD4, 1
  ENST ID: ENST00000618932
  CDS Start-End: 97-437
gaggctggagagcggtgagtggaggggccttccctgcgagaagtcagagctgtgcccgtgggcaggctggctccgctgttctgctccaaggattacatgtccttcaaacgtccctgcccctgtaagtttcctccccacatccttccaccacttggggccaggcaagggcagagcttggagtcgagctgcagagaacggcttgaggtgtttggccaaagaactgcaggggtccaaccagaggctaatgtggcatgctgggtggggagagggcaacacggaagacccctgacgtctgcaagatgctccctgagaactgaaaatcgcactttggcccattcttctgtatcagcccttcccgaagtgtggatcggagttcctctgagggatgttaatgggatgacacacacccacacacaaataaaagactacatggccaa

SEQ ID NO: 111891 - DNA, 1171 bp, Homo sapiens
  Payload ID: 1929
  Gene Symbol: BEAN1
  Gene Name: brain expressed, associated with NEDD4, 1
  Uniprot ID: Q3B7T3
  ENST ID: ENST00000622872
  CDS Start-End: 545-1171
gacgcccgagcccgagcgcagtggcctccgagcgggaaccggactgggagccggagccggggcgggaaccggagctggagccgaagctggagccggcactgcggcgcacggagcggagcgctgcagccaagccgagtgagtggaggggccttccctgcgagaagtcagagctgtgcccgtgggcaggctggctccgctgttctgctccaaggattacatgtccttcaaacgtccctgccccttagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggggtctcactcagtcgcctacgctggagtgcaatgatgtacactgggagctttacctactgggtgcgatctatgctttccagacacaaactggacgccatcctgggcaggctgggctacacggccaccttggagtctgagttctcactggtccaggccatcagcaaagagaatgtcaagcagatggtgttcaagatcttcctggtgagggtctcatgtgaagccgttctcagaaccgcgggcacacggatgcttgagccgggcacagagaaactcgctaggacccacagcaggcacagctcagagaaaaggctggtgaagccctgcagctgcctcgagggggttcagccaggcccaggttccgggggaccacagcaaggtccctcagaaggggtggggtccgagacggccctggcagagggcactgctggccagagatctctgcccatggctctgagcccatctgaggtctcaacagcccccaacagcctccccagtggctctccagtcctctag

SEQ ID NO: 111892 - DNA, 864 bp, Homo sapiens
  Payload ID: 1930
  Gene Symbol: BEX1
  Gene Name: brain expressed, X-linked 1
  Uniprot ID: Q9HBH7
  ENST ID: ENST00000372728
  CDS Start-End: 241-618
cttggcggtgacgcacggccctcacgtgaccgggagctgcagagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagtcagcactgacccccctcaccatgaccatcatgatgagttttgccttatgccctgaatcctgatggtttccctaaagttattacggaaacagacccctgctttcgaatttacatgttcatgatgtgcccttgttgtaaacctttacctgtcacttgtttacgtgggtctcctattaccagcttctaattgaatattgtgtttttgaaccagtctgtaagatttttgttagcagaagaattttacctattgcatggaaagatgctcattatagtgaagttaataaagcacctttaaaaagcaa

SEQ ID NO: 111893 - DNA, 1066 bp, Homo sapiens
  Payload ID: 1931
  Gene Symbol: BEX4
  Gene Name: brain expressed, X-linked 4
  Uniprot ID: Q9NWD9
  ENST ID: ENST00000372691
  CDS Start-End: 121-483
tggcgtcagagccgtcgtggctcgttccattctcggcggtggtacctgctcccggtggccctgaggacgtgtgggccaggggcggccccgaaattaggaagcggagggggagcaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggggtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagt

SEQ ID NO: 111894 - DNA, 1328 bp, Homo sapiens
  Payload ID: 1931
  Gene Symbol: BEX4
  Gene Name: brain expressed, X-linked 4
  Uniprot ID: Q9NWD9
  ENST ID: ENST00000372695
  CDS Start-End: 236-598
gtgaccggccaacactgagtgttgtctcgctctggcgtcagagccgtcgtggctcgttccattctcggcggtggtacctgctcccggtggccctgaggacgtgtgggccaggggcggccccgaaattaggaagcggagggggagcagtctgcaggtctgcggggctaagtgtcgcggcggcgcacctcgcgtcaagaatccggaggaggagactgcaaggataggcccaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggggtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagataaatctgactttgatgggcaagtaattaaaaaagaaaagtatgagaccttaaaa

SEQ ID NO: 111895 - DNA, 857 bp, Homo sapiens
  Payload ID: 1932
  Gene Symbol: BEX5
  Gene Name: brain expressed, X-linked 5
  Uniprot ID: Q5H9J7
  ENST ID: ENST00000333643
  CDS Start-End: 304-639
atggtaattggaaatctgagctcacagtgacgtgacccttaggagacccagagccaatgcgtggattagtccctcctcctagttgcagtctggtagttgtcgctggccgtgtgacggctcgctgttgccctgaaggcaggcgagccagctgcccaggaaaggtggaaagtggtagaagctgacccctgagccctggcaggtctttaagtgcgtttgtgcagccgatttcaaggctaagagagaaagactgcctctgatccctgaaggaagaaaaaaaaaaaaaaaacaggaaaaaaactcaacatggaaaatgtccccaaggaaaacaaagttgtggagaaggccccagtgcagaatgaagcccccgctttaggaggtggtgaataccaggagcctggaggaaatgttaaaggggtttgggctccacctgccccgggttttggagaggatgtgcccaataggcttgtcgataacattgatatgatagatggagatggagatgatatggaacggttcatggaggagatgagagagctaaggaggaaaattagggaacttcagttgaggtacagtctgcgcattcttataggggaccctcctcaccatgatcatcatgatgagttttgccttatgccttgaatcttgaggttaataatcataaaatccctgctttctaaattcgcatttttcctggtgtacctttaatgtgaaccttttggcattcttctgcaattttctgattggagattgcattttgacctagtctgtaagtttttctgtcagaagaggactttcatcaactttcatggaaagatgtttattgcatactgtaaagttaataaagcaatttaaaagca

SEQ ID NO: 111896 - DNA, 860 bp, Homo sapiens
  Payload ID: 1932
  Gene Symbol: BEX5
  Gene Name: brain expressed, X-linked 5
  Uniprot ID: Q5H9J7
  ENST ID: ENST00000543160
  CDS Start-End: 303-638
caccctttccagatacacacccgtttagtgcgagaaatggagcggttggggagaggatctcccgagggggctggattgagaatgggtaccatttgagatctcctaggaggccggccatcgggcaatgtctgatggagtccagccggtggaggagactgaaaggaaacagcctgcttcctgcaggtccgcgggagggaggtctttaagtgcgtttgtgcagccgatttcaaggctaagagagaaagactgcctctgatccctgaaggaagaaaaaaaaaaaaaaaacaggaaaaaaactcaacatggaaaatgtccccaaggaaaacaaagttgtggagaaggccccagtgcagaatgaagcccccgctttaggaggtggtgaataccaggagcctggaggaaatgttaaaggggtttgggctccacctgccccgggttttggagaggatgtgcccaataggcttgtcgataacattgatatgatagatggagatggagatgatatggaacggttcatggaggagatgagagagctaaggaggaaaattagggaacttcagttgaggtacagtctgcgcattcttataggggaccctcctcaccatgatcatcatgatgagttttgccttatgccttgaatcttgaggttaataatcataaaatccctgctttctaaattcgcatttttcctggtgtacctttaatgtgaaccttttggcattcttctgcaattttctgattggagattgcattttgacctagtctgtaagtttttctgtcagaagaggactttcatcaactttcatggaaagatgtttattgcatactgtaaagttaataaagcaatttaaaagcagtct

SEQ ID NO: 111897 - DNA, 780 bp, Homo sapiens
  Payload ID: 1933
  Gene Symbol: BRI3
  Gene Name: brain protein I3
  Uniprot ID: O95415
  ENST ID: ENST00000297290
  CDS Start-End: 122-499
gcgtctgcctcagaggggcccgagccacccggtccgccgcgtccccgccgccgccgccgcgtcccccgccggggccgaccgagccgagccgggccggagcggcgggcgcggccgggccgccatggaccacaagccgctgctgcaggagcggccgcccgcctacaacctggaggccggccagggcgactacgcgtgcggcccgcacggctacggcgccatccccgccgcgcccccgccgccgccctacccctacctcgtcacagggatacccacccaccatcccagggtctacaacatccacagccggaccgtcacccgctatcctgccaactctatcgtggtcgtaggaggctgtcctgtctgcagggttggggtgctggaggactgcttcaccttcctgggcatcttcctggccatcatcctcttcccctttgggttcatttgctgttttgccttgaggaagcgacgatgccccaactgtggagccaccttcgcttaaagggaacaccaggcccggctttcctacacccagctctctttttctaatgtaaatgttgtgtacaataattttatttgattaagcttcaggactgttttgtaaagcgaggtgggaccgatgtggcacacgccagctgcggtttcccggagcgtggagaggcagtgctgctgctcccgcccgaggctcatgacaactcaataaagcactgcttttattttttgcagtcttcaatttgagaaaggtgagaaataatgttttcaataaatgagattcataccatt

SEQ ID NO: 111898 - DNA, 699 bp, Homo sapiens
  Payload ID: 1933
  Gene Symbol: BRI3
  Gene Name: brain protein I3
  ENST ID: ENST00000539286
  CDS Start-End: 130-426
cccgccccgcgtctgcctcagaggggcccgagccacccggtccgccgcgtccccgccgccgccgccgcgtcccccgccggggccgaccgagccgagccgggccggagcggcgggcgcggccgggccgccatggaccacaagccgctgctgcaggagcggccgcccgcctacaacctggaggccggccagggcgactacgcgtgcggcccgcacggctacggcgccatccccgccgcgcccccgccgccgccctacccctacctcgtcacagggatacccacccaccatcccagggtctacaacatccacagccggaccgtcacccgctatcctgccaactctatcgtggtcgtaggaggctgtcctgtctgcaggcaccagaggtcatcctggctttacacgtatcctttgagagtctgtacctgattcaaacacggagaaaccaggaccccgagcagtttgagtgtactggtaatggatgcagctttggccaactagctgagtgagaacacaaggagccgtgactccgacgcccaggcctgtgtcctggatgggccgtgtgcagcgaatccgttggcgactcctaactaccaagaaaaggagctctcggaggagatttcgtcgagtgctacgtgtggctgtgataagggcaggcaaagcgtcttagcactctacagctctggcgtggttggagggagg

SEQ ID NO: 111899 - DNA, 567 bp, Homo sapiens
  Payload ID: 1933
  Gene Symbol: BRI3
  Gene Name: brain protein I3
  ENST ID: ENST00000491463
  CDS Start-End: 1-144
atccacagccggaccgtcacccgctatcctgccaactctatcgtggtcgtaggaggctgtcctgtctgcagcaacttcgtgtacgacgacgggaaccaacccctcctaccggcaaagagggagaaaagaccctatcagcagtagacatgtggacggcaacctccctgaacaacctggtgagagctcagggcagacaggtccactgctccagaaacgcccatgtgtggaggaaatgaaattaaggcttttaatagagtcttgctctgtcacccaaggctggagtgcaatggcgagatctcggctcactgcaacctgcgcctcccaggttcaatcctgcctcagcctcccgagtagctgggattacaggcgcctgccaccacgcctggctaatttttgtatttttcgtagagatggggtttcaccatgttggccaggctggtctggaactcctaacctcaggtgatctgcccgccttagcctcccaaagtgctgggattacaagcatgagccactgcactggccaaatgctaaattttttttaaaaacaaaagaatgtttaaactactt

SEQ ID NO: 111900 - DNA, 4340 bp, Homo sapiens
  Payload ID: 1934
  Gene Symbol: BDNF
  Gene Name: brain-derived neurotrophic factor
  Uniprot ID: P23560
  ENST ID: ENST00000314915
  CDS Start-End: 645-1412
attattaaagcggtagtctgccggcgctgataagcaacaagttccccagcggtcttcccgccctagcctgacaaggcgaaggttttcttacctggcgacagggaaatctcccgagccgaattcagcttcgccggagccccaggtgtgacctgcgtagtgggcaagggagcggtgtgcaggctgagtttttttttttacaggggtaccctgaaactcctcactttctctgggaactttcagtgccaggacccagtaacgggcggttagaaggcagccctaggaaacacctgctacatagcagggcagttgggcaatcattggtaacctcgctcattcattagaatcacgtaagaactcaaaaggaaacgtgtctctcggagtgagggcgtttgcgtaaatctataggtttttcgacatcgatgccagttgctttgtcttctgtagtcgccaaggtggttgagagtttaagcttgcggatattgcaaagggttattagattcataagtcacaccaagtggtgggcgatccactgagcaaagccgaacttctcacatgatgacttcaaacaagacacattaccttccagcatctgttggggagacgagattttaagacacttgagtctccaggacagcaaaggcacaatgttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111901 - DNA, 4018 bp, Homo sapiens
  Payload ID: 1934
  Gene Symbol: BDNF
  Gene Name: brain-derived neurotrophic factor
  Uniprot ID: P23560
  ENST ID: ENST00000356660
  CDS Start-End: 347-1090
agagctaaataatgtctgacccgggcgcaaggcgcagcctggagctccgggtccccgacgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111902 - DNA, 3988 bp, Homo sapiens
  Payload ID: 1934
  Gene Symbol: BDNF
  Gene Name: brain-derived neurotrophic factor
  Uniprot ID: P23560
  ENST ID: ENST00000395978
  CDS Start-End: 317-1060
gtgtgtaatccgggcgataggagtccattcagcaccttggacagagccaacggatttgtccgaggtggcggtacccccaggtagtcttcttggccccgctgtaaagccaaccctgtgtcgcccttaaaaagcgtcttttctgaggttcggctcacactgagatcggggctggagagagagtcagattttggagcggagcgtttggaaagcgagccccagtttggtcccctcattgagctcgctgaagttggcttcctagcggtgtaggctggaatagactcttggcaagctccggttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111903 - DNA, 4030 bp, Homo sapiens
  Payload ID: 1934
  Gene Symbol: BDNF
  Gene Name: brain-derived neurotrophic factor
  Uniprot ID: P23560
  ENST ID: ENST00000395980
  CDS Start-End: 359-1102
acccactttcccattcaccgcggagagggctgctctcgctgccgctccccccggcgaactagcatgaaatctccctgcctctgccgagatcaaatggagcttctcgctgatggggtgcgagtattacctccgccatgcaatttccactatcaataatttaacttctttgctgcagaacagaaggagtacataccgggcaccaaagactcgcgccccctcccccctttaattaagcgaagggaacgtgaaaaaataatagagtgtgggagttttggggccgaagtctttcccggagcagctgccttgatggttactttgacaagtagtgactgaaaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111904 - DNA, 4071 bp, Homo sapiens
  Payload ID: 1934
  Gene Symbol: BDNF
  Gene Name: brain-derived neurotrophic factor
  Uniprot ID: P23560
  ENST ID: ENST00000395981
  CDS Start-End: 400-1143
gtgtgtaatccgggcgataggagtccattcagcaccttggacagagccaacggatttgtccgaggtggcggtacccccaggtagtcttcttggccccgctgtaaagccaaccctgtgtcgcccttaaaaagcgtcttttctgaggttcggctcacactgagatcggggctggagagagagtcagattttggagcggagcgtttggaaagcgagccccagtttggtcccctcattgagctcgctgaagttggcttcctagcggtgtaggctggaatagactcttggcaagctccgggttggtatactgggttaactttgggaaatgcaagtgtttatctccaggatctagccaccggggtggtgtaagccgcaaagaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111905 - DNA, 3776 bp, Homo sapiens
  Payload ID: 1934
  Gene Symbol: BDNF
  Gene Name: brain-derived neurotrophic factor
  Uniprot ID: P23560
  ENST ID: ENST00000395983
  CDS Start-End: 105-848
gtaaaccaatagcccccatgctctgtgcgatttcattgtgtgctcgcgttcgcaagctccgtagtgcaggaaggtgcgggaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111906 - DNA, 3979 bp, Homo sapiens
  Payload ID: 1934
  Gene Symbol: BDNF
  Gene Name: brain-derived neurotrophic factor
  Uniprot ID: P23560
  ENST ID: ENST00000395986
  CDS Start-End: 263-1051
acacggctacctgctccccaggaattgagactgaagtggacttacaagtccgaagccaatgtagcttggaaaacttgggaggcggaattcctaccgctgggaactgaaagggtctgcgacactctcgggcaggccgaacccacatctctacccatcctgcgcccctcttctgaagcgccctccagggaagttaagagttttgactttcggggagtggttgggatgtacgtgggggattcttgactcgggttagtctctggggatgcagagccgggaagaggaatggttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111907 - DNA, 4532 bp, Homo sapiens
  Payload ID: 1934
  Gene Symbol: BDNF
  Gene Name: brain-derived neurotrophic factor
  Uniprot ID: P23560
  ENST ID: ENST00000439476
  CDS Start-End: 861-1604
gcgcgcgcgcacacacacacacacacacagagagaacatctctagtaaaaagaaaagttgagctttcttagctagatgtgtgtattagccagaaaaagccaaggagtgaagggttttagagaactggaggagataaagtggagtctgcatatgggaggcatttgaaatggacttaaatgtctttttaatgctgactttttcagttttctccttaccagacacattgttttcatgacattagccccaggcatagacacatcattaaaatgaacatgtcaaaaaatgatttctgtttagaaataagcaaaacattttcagttgtgaccacccaggtgtagaataaagaacagtggaattgggagccctgagttctaacataaactttcttcatgacataaggcaagtcttctatggcctttggtttccttacctgtaaaacaggatggctcaatgaaattatctttcttctttgctataatagagtatctctgtgggaagaggaaaaaaaaagtcaatttaaaggctccttatagttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111908 - DNA, 4176 bp, Homo sapiens
  Payload ID: 1934
  Gene Symbol: BDNF
  Gene Name: brain-derived neurotrophic factor
  Uniprot ID: P23560
  ENST ID: ENST00000420794
  CDS Start-End: 505-1248
gtaaaccaatagcccccatgctctgtgcgatttcattgtgtgctcgcgttcgcaagctccgtagtgcaggaaggtgcgggaagttaagtaattaaaagaaattatagagtgggatgcaaaaataacccgaaggacaactggatgtgtggagccaccagttttctccatgagtgcacaaggttaatccttgttactactcagaatgctgagtttctacagaaagggttgcaggtccacacatgttttggcgtctacccacacgcttctgtatggcatgactgtgcatcccagaagaagggctgtgctgtgtacctccacgtttcagtggaatttaacaaactgatccctgaaaatggtttcataaagggatggtaataaagtctcttagtggttgaaaatgttatttcttacaaaagtggagaacatttgcttttcaataccagagttttcagccatttctgcattctgacctattgactggagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111909 - DNA, 4125 bp, Homo sapiens
  Payload ID: 1934
  Gene Symbol: BDNF
  Gene Name: brain-derived neurotrophic factor
  Uniprot ID: P23560
  ENST ID: ENST00000418212
  CDS Start-End: 454-1197
agagctaaataatgtctgacccgggcgcaaggcgcagcctggagctccgggtccccgacgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgagcatgagcagagatcattaaaaattaaacttacaaagctgctaaagtgggaagaaggagaacttgaagccacaatttttgcacttgcttagaagccatctaatctcagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111910 - DNA, 4059 bp, Homo sapiens
  Payload ID: 1934
  Gene Symbol: BDNF
  Gene Name: brain-derived neurotrophic factor
  Uniprot ID: P23560
  ENST ID: ENST00000438929
  CDS Start-End: 142-1131
gtaaaccaatagcccccatgctctgtgcgatttcattgtgtgctcgcgttcgcaagctccgtagtgcaggaaggtgcgggaagttaagtaattaaaagaaattatagagtgggatgcaaaaataacccgaaggacaactggatgtgtggagccaccagttttctccatgagtgcacaaggttaatccttgttactactcagaatgctgagtttctacagaaagggttgcaggtccacacatgttttggcgtctacccacacgcttctgtatggcatgactgtgcatcccagaagaagggctgtgctgtgtacctccacgtttcagtggaatttaacaaactgatccctgaaaatggtttcataaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111911 - DNA, 3829 bp, Homo sapiens
  Payload ID: 1934
  Gene Symbol: BDNF
  Gene Name: brain-derived neurotrophic factor
  Uniprot ID: P23560
  ENST ID: ENST00000525950
  CDS Start-End: 158-901
aatatcaagtatcacttaattagagatttttaagccttttcctcctgctgtgccgggtgtgtaatccgggcgataggagtccattcagcaccttggacagagccaacggatttgtccgaggtggcggtacccccagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111912 - DNA, 4000 bp, Homo sapiens
  Payload ID: 1934
  Gene Symbol: BDNF
  Gene Name: brain-derived neurotrophic factor
  Uniprot ID: P23560
  ENST ID: ENST00000533246
  CDS Start-End: 329-1072
agagctaaataatgtctgacccgggcgcaaggcgcagcctggagctccgggtccccgacgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111913 - DNA, 3878 bp, Homo sapiens
  Payload ID: 1934
  Gene Symbol: BDNF
  Gene Name: brain-derived neurotrophic factor
  Uniprot ID: P23560
  ENST ID: ENST00000533131
  CDS Start-End: 207-950
acacggctacctgctccccaggaattgagactgaagtggacttacaagtccgaagccaatgtagcttggaaaacttgggaggcggaattcctaccgctgggaactgaaagggtctgcgacactctcgggcaggccgaacccacatctctacccatcctgcgcccctcttctgaagcgccctccagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111914 - DNA, 4176 bp, Homo sapiens; identical to SEQ ID NO: 111908
  Payload ID: 1934
  Gene Symbol: BDNF
  Gene Name: brain-derived neurotrophic factor
  ENST ID: ENST00000530786
  CDS Start-End: 142-375

SEQ ID NO: 111915 - DNA, 3918 bp, Homo sapiens
  Payload ID: 1934
  Gene Symbol: BDNF
  Gene Name: brain-derived neurotrophic factor
  Uniprot ID: P23560
  ENST ID: ENST00000530861
  CDS Start-End: 247-990
agagttgaaagctaggggagcgagacctcggggcgtgcgattctcactcgctccctcccgccccagcgcccacagccggggtttctgcagagggcgcgggacgcggggttccccggggctgaggctggggctggaacacccctcgaagccgcgggcgtcctgtccaaggcgccccaggagggcgcaggactcgcagggcgatgtcgcggggccctaggggaggagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111916 - DNA, 3930 bp, Homo sapiens
  Payload ID: 1934
  Gene Symbol: BDNF
  Gene Name: brain-derived neurotrophic factor
  Uniprot ID: P23560
  ENST ID: ENST00000532997
  CDS Start-End: 259-1002
cttccaccccgccccctcctccagcctccatccctccctcattctatctcttcctctccgtcgccctcgctcctcgctggatgcttctttctgggttttcttttttttttcccttctgtcctccctccccgcgagtttcgggcgctggcttagagggttcccgctttctcaagggaaggggagctgccgagaccgcgctccgctccccagccgggccggatgcctcactgagcccagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111917 - DNA, 4766 bp, Homo sapiens
  Payload ID: 1934
  Gene Symbol: BDNF
  Gene Name: brain-derived neurotrophic factor
  Uniprot ID: P23560
  ENST ID: ENST00000525528
  CDS Start-End: 1095-1838
gcgcgcgcgcacacacacacacacacacagagagaacatctctagtaaaaagaaaagttgagctttcttagctagatgtgtgtattagccagaaaaagccaaggagtgaagggttttagagaactggaggagataaagtggagtctgcatatgggaggcatttgaaatggacttaaatgtctttttaatgctgactttttcagttttctccttaccagacacattgttttcatgacattagccccaggcatagacacatcattaaaatgaacatgtcaaaaaatgatttctgtttagaaataagcaaaacattttcagttgtgaccacccaggtgtagaataaagaacagtggaattgggagccctgagttctaacataaactttcttcatgacataaggcaagtcttctatggcctttggtttccttacctgtaaaacaggatggctcaatgaaattatctttcttctttgctataatagagtatctctgtgggaagaggaaaaaaaaagtcaatttaaaggctccttatagttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcaggtttatatgctagatcttgggggaaacactgcatgtctctggtttatattaaaccacatacagcacactactgacactgatttgtgtctggtgcagctggagtttatcaccaagacataaaaaaaccttgaccctgcagaatggcctggaattacaatcagatgggccacatggcatcccggtgaaagaaagccctaaccagttttctgtcttgtttctgctttctccctacagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctgtatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaa

SEQ ID NO: 111918 - DNA, 2674 bp, Homo sapiens
  Payload ID: 1935
  Gene Symbol: BEGAIN
  Gene Name: brain-enriched guanylate kinase-associated
  Uniprot ID: Q9BUH8
  ENST ID: ENST00000355173
  CDS Start-End: 73-1854
ctgctttgtctgctgtcccctctctgctggagaacttagcccagagctagtgaacgagcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccggcccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtggaaag

SEQ ID NO: 111919 - DNA, 2744 bp, Homo sapiens
  Payload ID: 1935
  Gene Symbol: BEGAIN
  Gene Name: brain-enriched guanylate kinase-associated
  Uniprot ID: Q9BUH8
  ENST ID: ENST00000443071
  CDS Start-End: 147-1928
gcggcgccgggcttcccacggacggggccccgcggggttgcccggccgtgcccgctgtgcccggctctgcccggcgcggccgcggagcgcacgcctcctgcctgctgaccctctcgtttggtttctcgcaggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccggcccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtgg

SEQ ID NO: 111920 - DNA, 649 bp, Homo sapiens
  Payload ID: 1935
  Gene Symbol: BEGAIN
  Gene Name: brain-enriched guanylate kinase-associated
  ENST ID: ENST00000557378
  CDS Start-End: 147-649
gcggcgccgggcttcccacggacggggccccgcggggttgcccggccgtgcccgctgtgcccggctctgcccggcgcggccgcggagcgcacgcctcctgcctgctgaccctctcgtttggtttctcgcaggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatcccc

SEQ ID NO: 111921 - DNA, 632 bp, Homo sapiens
  Payload ID: 1935
  Gene Symbol: BEGAIN
  Gene Name: brain-enriched guanylate kinase-associated
  ENST ID: ENST00000554140
  CDS Start-End: 124-632
cctgcgggaagccgggcggggtgggggagccccggccgcgccggctcccggcgcgctcggcctcggaggggagggggcggcggtagcggcggcggcggtgagcggcgcggctgccctggggccatgtggactggcggtcgccggccgggccggctgcgccgggcggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttcca

SEQ ID NO: 111922 - DNA, 5811 bp, Homo sapiens
  Payload ID: 1935
  Gene Symbol: BEGAIN
  Gene Name: brain-enriched guanylate kinase-associated
  ENST ID: ENST00000556751
  CDS Start-End: 3406-4995
gctgtttccagacgctggggactccctgacccatctcggcccttgccaggacaccttttcacccagggcaggggacagaggcctctgagccacaggcctccagcagtttcccccagattcccagtggcctggtggccccaccccacacagtgccacctcttgacattgtccactgtgtggagggtgctactatgtagaatgtggaccagcaacagccctgcccccgtgtctgggtgcaccatccagttctgcagatgtggagacaggctgccgtggcagggctcgggttattgcccggtgtggggaacactggacagggaaggaggtactacccgggtgaccgcagaccctaggtacacagcctggactgggcagaggggacacgttcagaggtgtgagaagctgaacccccaggacttagtgacagggctgtgaggggtaaagaggggtcaccatgcccaccccccgggtggggaacgtggagggcagtgaaggtgtggtggatgtggctgcattggacgggttgggtgtggagatgcctgagggccataggtgggtggctggacgtggtgagggtatggagcctgacagacaccccgctggagtcagatggaaacctgggaggggtccctgtgcagctggcttggaggggatttggtctgagcatgcagggcaggggtgcaggtgcaaaccggggccccagggaacagcccgggcgaggtcgggaggggcctgtggtgtgatcgccggaccagcagaggtggggaaagacgtggcaggaaccctggggcggccaagtgcggggcatcagctatgcctggggacggggtgcgtgtccatggcccgatgcctgcagcaagcggacactgaggcagagaggggtgtgagagtcaggggctgggggcactgctagcccaaagattggttgggtgtagcaggtggttgggtgtgaaggacttggggagggggagcagtatttaagggctggtggaacagggagttgactgctgtatctggaaggccatccaaaggccaggggtaaactgaggctctgtgaagctgcctgacttgtgagatgtctgccccgagcccaccccatagccccttcgtcctcccctcccacacctgccccgtggagaatccctgcctagctcattgtctgcctcccctctggaccgcaggctcccggggcaggggcagggtttgtcttactcctggctgtgaggtctcagacaggttgcttgctctgagaggtgagggtagggacctcagggtgcccagaaggggcagggctgggtgagggggcacagtgagctaggggtgcaggtctcagaatagcaaggacctaaggctgctcagtgaggcctggggtgtggctggagaaggggtgaggactcggggctgaggtggccacgtgggtggatggatgacgccctcacctcttcccgagggctgtgggtacaccaggagcccctgcagggaacagtcgacttcaggggctgctgtgcagcccattgtgcctgccctaggagcccaggatggcataggagtccccaggaagttcaccacctccctggggaggacaggtctgtgtgggaagcagcctgggacctgtagctatagagtgctagaagtggggcagccacggaaggctgcctggaggaggtggaaggaggcctgagcactgtcccagagagcgctcccggaggcagacccacgtgggcagctgtggcactttgcctcagggcttccctctttgcttgttactctacttcctcttgtggtgactgactcttgggaagacccgccctgcccttctctgaggttctcaaaaacgtaagcgacgctttatttttatttgtttttaaaaatatagccctgggcaggaatccaagagtgcttcctggaggcttgctgggtgtgtgcccgcagtgccacatgcggtttactcacggggcccagacagaagatgcctctgctcggggctgggggacagtggtggccccagggggactgggagcctcctgcctgccctctactcccctcgcttgggtttgggtcgggaatatcacaagaacgcgggcttttgcccaaggtcccacagcacatctgggcagagtcagggttccaggccctctcccacacctcaagtttccttcatgacacccgggacttctgcctgtcccgtccccatctcacagcaacacaatccaaaagatgttggtcccagatagcccctgggctgtgcacccattgcaaggaaagaactgctggctgctgaccccactctgacccagacaaccggaagtgcagcccctgccttggggagctccgagccatccctgttggaggcccccacactaccctcctgcctttgcacagctttagttcaggtgaattgttggcaggtggctcggaagagtgggtcatagtgggtctctgtttcctgagcatgtggggctctgcatcctggggtcctaccctccaggagaccccattctgggggaagaaaatagagcctcaagaattgtctgggtttctggaaggcttcctggaggaaggggaacttgagcaggccaggaccttgccaggtttcccgtgctgcatgcagcctcattggccatggtggcagacactgcccgggcatgggacattgccaccaaacatctctctggcccagagaagtgacccagggtcccagggccacacagccattttggggaaagcaggtctggtcttgggcatggcactgctgactctgggcctcagccatcccaacctagcactgtggaggagcaggagtgagggccccagtcacctgtgccacccagggccagctctgtgatagcctgggtgctgatgggtgctctttgtacctgggtcctttaaaccgcccccaacacactggccaggttctggggtcaaagactcctccagccaccacctgggatttacctgtgtgagggacactggtggagtctgaggaaccgcccaggccagactggctcagggtcagagtccctgactctggggcgccatggtcttcagtgacgcccgggaggctgggtgtgtgtgagtgtgtgtgtgtgtgtgtgtgtgtgtgtgtgtgcgcgcgcgcgcgcgcgccggtactcgcgtgttagtgcggcacgccccggctggcctgcgggccttagtttcccccgctcagcgccgcggcccggcccgccgccgccatgtcgttgcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccccagctacgcaggctcactgcccacgtccagctcctactccagcttcagcgccacgtcggaggagaaggagcacgcgcaggccagcacgctgaccgcgtcgcagcaggccatctacctgaacagccgcgacgagctcttcgaccgcaagccacccgccaccacctacgagggcagccctcgctttgccaaggccacggccgcggtggcggccccgctggaggccgaagtggccccaggcttcgggcggaccatgtcaccgtacccggccgagaccttccgcttcccggcctctccgggtccccagcaggccctgatgcccccaaacctgtggagcctgcgggccaagccggggaccgcccggctccccggggaggacatgaggggccagtggcgtcccctgagcgtggaggacatcggcgcctactcctaccccgtgagcgctgccggccgcgcctcaccctgcagcttctctgaacgctactacggcggggccgggggcagcccgggcaagaaggccgacggccgcgccagcccgctctacgccagctacaaggccgacagcttctccgagggggacgacctctcccagggccacctggcagagccctgcttcctgcgggcgggcggcgacctgagcctcagtcccggccgctcggctgacccactgcccggctatgcacccagcgaggggggggacggggacaggctcggggtgcagctgtgtgggaccgccagcagccctgagcccgagcagggttccagggactccttggagccgagctccatggaggcctccccggaaatgcatcctgccgcccgcctcagcccccagcaggcctttccgcggactggtggctcggggctgagccgcaaggacagcctcaccaaggcccagctctacggaaccttgctcaactgagcgcctgcgtgcaggcctggccgtggttcgctccccgccagcccacgtgccccagaagggccggcctcacctctccccagcccccgctgttcccctgccccggccaacaacgaggagtctgttcctccccgcacctcctctcctccccagccctgtaggcctgaggggagggtcccccacaccacggtgtccacccggccccggcccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtgg

SEQ ID NO: 111923 - DNA, 925 bp, Homo sapiens
  Payload ID: 1935
  Gene Symbol: BEGAIN
  Gene Name: brain-enriched guanylate kinase-associated
  ENST ID: ENST00000553553
  CDS Start-End: 27-925
ccctgattgaggagtcgaggctccaaatgccatcgccctcggattgtgcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccc

SEQ ID NO: 111924 - DNA, 1010 bp, Homo sapiens
  Payload ID: 1935
  Gene Symbol: BEGAIN
  Gene Name: brain-enriched guanylate kinase-associated
  ENST ID: ENST00000556188
  CDS Start-End: 148-1010
ccaggaggggaaagggccaggaaagacaggctccagtgccgtaggatccaggcatgcactgtccgtgtttattgagcgcctgctgtatgctgggacctagcatgagaagcgctgtcatggggacccggaaaggcctctgccgcagacatggagaaactcagcgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcggcggcgagaccggcggcctagcgtggacgcgcccgtgaccgacgtgggcttcctgcgggcccagaactccactgacagcgcggccgaggaggaggaggaggccgaggcggcggccttcccggcgggcttccagcatgaggccttccc

SEQ ID NO: 111925 - DNA, 747 bp, Homo sapiens
  Payload ID: 1935
  Gene Symbol: BEGAIN
  Gene Name: brain-enriched guanylate kinase-associated
  ENST ID: ENST00000554356
  CDS Start-End: 224-747
ctcttgggaagacccgccctgcccttctctgaggttctcaaaaaccgcgctgcaggagcagaagggcgagctgcgcaagcggctgtcctacaccacacacaagctcgagaagctcgagaccgagttcgactccacgcgccactacctggagatcgagctgcggcgcgcgcaggaggaactggagaaggtcacggagaagctgcgcaggattcagagcaactacatggcactgcagaggatcaaccaggagctggaggacaagctgtaccgcatgggccagcactatgaggaggagaagcgtgcgctgagccacgagattgttgccctcaacagccatctgctagaagccaaggtgaccatcgacaagctgtcagaggacaacgagctctataggaaggactgcaatctagcggcccagctgctgcagtgcagccagacctacggcagggtccacaaggtgtctgagctgccctcggatttccaggagcgcgtgagcctgcacatggagaagcacggctgcagcctgccatccccgctctgccacccggcctacgccgacagcgtccccacctgcgtcattgccaaggtgctggagaagccggaccccgccagcctgtcctcccgcctgtccgatgcctccgcccgcgacctggccttctgcgacggggtggagaaaccaggcccgcggcccccctacaagggagacatctactgcagtgacacagccctctactgcccggaggagcg

SEQ ID NO: 111926 - DNA, 830 bp, Homo sapiens
  Payload ID: 1936
  Gene Symbol: BSX
  Gene Name: brain-specific homeobox
  Uniprot ID: Q3C1V8
  ENST ID: ENST00000343035
  CDS Start-End: 50-751
tcctccacttcgtcccggcccttgtcctgtggcaggtgctccgctcaagatgaatctcaacttcacctctcctctacacccggcgtcttctcagaggcccacatccttcttcatcgaggacatcctgctgcacaagcccaagccgctgagagaggtggccccagaccatttcgccagctctctggcctctcgggtgcctctgctagactatggctaccccctcatgcccacacccaccctcttggctcctcacgcccatcaccctctgcataagggagaccaccatcatccttatttcctcaccacctcggggatgccagtcccagcgctgttcccgcacccgcagcacgcggagctgccggggaagcactgccgccgccgcaaagcccgcacggttttctctgactcgcagctctcgggcttggagaagaggttcgagatccagcgctacctgtccacgccagaacgagtggagctggccacggccctcagcctgtccgagacgcaggtgaaaacgtggttccagaaccggcggatgaagcataaaaagcaactgcggaaaagccaagacgaacccaaagcaccagacgggccagaaagccccgagggcagcccccgcggttcagaggccgccaccgccgccgaggctcggctgagcctgcccgccggtcccttcgtgctgaccgagccagaggacgaggtggacattggagacgagggggagctgggctcagggccgcacgtgctctgagccgccaggctggggagggtagtaggcaggggaggagactgcggggccgagcgcggttccctcctggaccggaagactc

SEQ ID NO: 111927 - DNA, 9674 bp, Homo sapiens
  Payload ID: 1937
  Gene Symbol: BCAT1
  Gene Name: branched chain amino-acid transaminase 1, cytosolic
  Uniprot ID: P54687
  ENST ID: ENST00000261192
  CDS Start-End: 528-1688
agtagggaggtgggcaggagccagtgatgacggaatggcaatcacatttgacctctgatctgtttatttcctcctccttgacgtctccatataaatgttacacgggcatccccacactcggatacgcacccacagtggctgattcgggggtaaccgtgtcatttgcttgcaacactggcacctctgccctgcaccccgggagtgagcagtgagtgaggctcgggtctgggcgctggctccgaatcttcgggctgggagagactccaccatctgggggcggcctgggggagcagccttagtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacatatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcataggagcacaaatcctattgtgaactctgcatgcaagggatctaggctatgcgctccttatgagaatctaatgcttgatgacctgaggtgtaacagtttcatcctgaaaccacccttcaccctgcagtctgtggaaaaattgtcttccacaaaactggtccctggtgccaaaaatgttggggaccactgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttgtggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatgataaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactaaatttctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagacaaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccatattagttttgttgcttcataaaatttacctaagcaagtggtcttgcttgcctcaaatccaagcagtcttgaacacttggaggcaattaatgagtatatcttagtcaaaagaattgttggagctttttattaaagctacagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacattgtttgttcactttcaaagagtgatagtttctaaaacatttagagcaataaatattcatcagaggtaccaagtaagccggcagaagagttaagggttagagaaatcccttatttcatgtcttgactctaaaattatcaaagtacttttccttgtaatgtggatttcttcttatgcggatatgcaaaaacttcagttatacgtagtaatgctagcaggtaattttagtagacattttataacaactgtcactttgtttcgccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatggcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactattggattctggagaaaaatttaatgaaagatgatatcagaggaagaataagtggaggtagagaagaaaggaatgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgacttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatgaaatcagcattgttgaatgcatgaagtaataatgctaaattaacatttttatgatgtctcaaggtttctggtcaagggaagtaaatgtaggatagtatttttacaccaaaatgacacagagagaattgagcacaccagaaagaccagaaaccacaccactggatagagattcaatatgtttctttttcaaacatttggacaagaaaaaaatgggcatttaaaaattcttccttcccctggttatggatttatctgtagtaaaacttagctttgtcgtttgagatttgcacagaatggggggagtagattacctcttcccattcattgtcataatggatctacatcactgataaacaccatacttctatatgtggttaactagctttagaataaaagacactttaaaaagtaaaaggcctagagatcttcaatgaagtgtcccttttagccaaaccaggccttgcagaaattgtcctcaaaagcaccaagggagaacaaagccaagtgcagaattacccaagggtcacacattttgtattcattttcttataatttgcccaaatgatttgaagtacagcaaaacctgaagttttgcaaagagttactgtaaactgaacttaaaaatgtcagagtgctcggtgacccacttctccagaccctgtcaacctgtgaaaatattggcctttattcagatctctcaagaagttacgcgcagagtttggaaggtctaggcaaaggttattagtcaagtgttcttacagtgtcaacgctcaattcccacaagcgtgagaaagagagacctgtcattcctgagggtgatgacatacatttactggagcttatataatttatcagataagacagcagtttccttcagggtagaaagtgtgttttctacattgatttagtacaaaacaaaaagaaaaggggatatttcaaattttataattatttttctgctaagctgattcagtgtgatttaagcatatttttcaaatcatgaatctgattccatatacatatgtgccttatattgtgataatttatttttaagtgaaatatgctatcatagcctgactttatgtatagtggtgacaacttgcaggatcgcatttctgtaaccaaacggccgacagctgaggtgtagatgcttcctatggtctgtagaataatcactgggcttgttctctagctatgtctgtatgcaatcgcgacagtgttgatcaaaacccatgatcattctctccaaaggtctttgtcactaagccactagggattctgaaaagttcgtgagctgaaacaaataaattgagttggaagattca

SEQ ID NO: 111928 - DNA, 4319 bp, Homo sapiens
  Payload ID: 1937
  Gene Symbol: BCAT1
  Gene Name: branched chain amino-acid transaminase 1, cytosolic
  Uniprot ID: P54687
  ENST ID: ENST00000342945
  CDS Start-End: 155-1132
acgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaagtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacatatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcataggagcacaaatcctattgtgaactctgcatgcaagggatctaggctatgcgctccttatgagaatctaatgcttgatgacctgaggtgtaacagtttcatcctgaaaccacccttcaccctgcagtctgtggaaaaattgtcttccacaaaactggtccctggtgccaaaaatgttggggaccactgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttgtggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatgataaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactaaatttctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagac

SEQ ID NO: 111929 - DNA, 549 bp, Homo sapiens
  Payload ID: 1937
  Gene Symbol: BCAT1
  Gene Name: branched chain amino-acid transaminase 1, cytosolic
  ENST ID: ENST00000546285
  CDS Start-End: 118-549
cttgctgcagccgggaccgcgctctgcagccgcagacccggtccacacggccaggggctacgacccttgggatctgccctccgctcagctcgagcttccctcgtggccgacggaacaatgaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattgga

SEQ ID NO: 111930 - DNA, 4694 bp, Homo sapiens
  Payload ID: 1937
  Gene Symbol: BCAT1
  Gene Name: branched chain amino-acid transaminase 1, cytosolic
  Uniprot ID: P54687
  ENST ID: ENST00000538118
  CDS Start-End: 332-1489
tgattgacaagaccacgaggctgagcgcgccctggagatttttctataaatggcttaacaccccagtctagactatttgctcggatataagggagacaattgtttttttgttctttgccggcgaaccctggctctgtagggctgacctggaatttaaccagtcttccctgagccggcggaggaggacaaaaaccgccgcgaccccggcagggtgggaagtgcagggcagcgctcccaagacacgcttgttggaggttcgggcctgggtgcttggttgtctgagcctccttttttgtgtttgcctgggtcctggagaggagcgcacggtatcatggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacatatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcataggagcacaaatcctattgtgaactctgcatgcaagggatctaggctatgcgctccttatgagaatctaatgcttgatgacctgaggtgtaacagtttcatcctgaaaccacccttcaccctgcagtctgtggaaaaattgtcttccacaaaactggtccctggtgccaaaaatgttggggaccactgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttgtggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatgataaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactaaatttctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagacaaaaaaaaaaaaaaaaaa

SEQ ID NO: 111931 - DNA, 1360 bp, Homo sapiens
  Payload ID: 1937
  Gene Symbol: BCAT1
  Gene Name: branched chain amino-acid transaminase 1, cytosolic
  Uniprot ID: P54687
  ENST ID: ENST00000539780
  CDS Start-End: 112-1161
gcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaagtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttg

SEQ ID NO: 111932 - DNA, 1811 bp, Homo sapiens
  Payload ID: 1937
  Gene Symbol: BCAT1
  Gene Name: branched chain amino-acid transaminase 1, cytosolic
  Uniprot ID: P54687
  ENST ID: ENST00000539282
  CDS Start-End: 88-1284
gcttggccacaccgcctgctttcgcttccagccgcgcgctccgtgccactgccgctctctgcagccccgcgtccccgcagcctccccatggccagcccgcttcgctccgctgcggcccttgcccgccaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaa

SEQ ID NO: 111933 - DNA, 675 bp, Homo sapiens
  Payload ID: 1937
  Gene Symbol: BCAT1
  Gene Name: branched chain amino-acid transaminase 1, cytosolic
  ENST ID: ENST00000612790
  CDS Start-End: 1-675
tgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtgggtgggtgcctttgatatgaacaacttttgtaagcctgaaataaaaaataatcaaaataagccca

SEQ ID NO: 111934 - DNA, 1552 bp, Homo sapiens
  Payload ID: 1938
  Gene Symbol: BCAT2
  Gene Name: branched chain amino-acid transaminase 2, mitochondrial
  Uniprot ID: O15382
  ENST ID: ENST00000316273
  CDS Start-End: 14-1192
cgccgcacggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaaca

SEQ ID NO: 111935 - DNA, 2041 bp, Homo sapiens
  Payload ID: 1938
  Gene Symbol: BCAT2
  Gene Name: branched chain amino-acid transaminase 2, mitochondrial
  ENST ID: ENST00000402551
  CDS Start-End: 622-1680
agttacgcgccgcacggatcatggccgcagccgctctggggcagaagcatggctgcaaggctgagcagtctagatgtcgccacccaaaggcaatctggggacccacgctctgatcaccccggaatccctggagcctcacaccagcaagaccacgctgcaggcccatctcccagcaactcacctagcgacaagtgaccacgcccattcacgtccatcttccagaatcagtgccaactcacccagctcacagggcaggccaggccaggccactctgtctctctcaacctcacgccccaacgcctccccacagggctggggaaagaggccttgtgaggtcaaaggtcaccagagagggcccagcctgctggacacagccagacctgctcttcctactcccctctgggaggacccgcctgagcctcatgcagtgaggactgcagtggctccccaggcccctgtagctgcccctcagccccaggggctgaagggaattggagtcactgccaaaatgggtttgtatttcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacac

SEQ ID NO: 111936 - DNA, 1272 bp, Homo sapiens
  Payload ID: 1938
  Gene Symbol: BCAT2
  Gene Name: branched chain amino-acid transaminase 2, mitochondrial
  Uniprot ID: O15382
  ENST ID: ENST00000545387
  CDS Start-End: 6-908
ggatcatggccgcagccgctctggggcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacacaca

SEQ ID NO: 111937 - DNA, 1664 bp, Homo sapiens
  Payload ID: 1938
  Gene Symbol: BCAT2
  Gene Name: branched chain amino-acid transaminase 2, mitochondrial
  ENST ID: ENST00000593515
  CDS Start-End: 1-1338
atctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtaccaggaacagataatggcctttcttattgaggccctggagagtgggctttctgtgctgctctgtggcctggaaaaccccttggggctaaatcaccctttcctgggagctcccggagccctggatatgtcttcagctttggaaaccccttcctgtgatcctctgcggctcctgggtgccctgtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtct

SEQ ID NO: 111938 - DNA, 1579 bp, Homo sapiens
  Payload ID: 1938
  Gene Symbol: BCAT2
  Gene Name: branched chain amino-acid transaminase 2, mitochondrial
  ENST ID: ENST00000597011
  CDS Start-End: 205-1263
tggcctgcagccggtccgactcggcgccgctcctcccgccctggggttccgctgcagggcgcggaggaggatggcgccctttggaaaggagcacgaggctttaatgggatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgattttttt

SEQ ID NO: 111939 - DNA, 1329 bp, Homo sapiens
  Payload ID: 1938
  Gene Symbol: BCAT2
  Gene Name: branched chain amino-acid transaminase 2, mitochondrial
  ENST ID: ENST00000598162
  CDS Start-End: 21-1238
agttacgcgccgcacggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccaggtgagctgcagggagctggggaatgggctgggagcttgttccctggagaagttggtgtcccatgagcccctggactaacagccagcctccttcagtagtaccaggaacagataatggcctttcttattgaggccctggagagtgggctttctgtgctgctctgtggcct

SEQ ID NO: 111940 - DNA, 1449 bp, Homo sapiens
  Payload ID: 1938
  Gene Symbol: BCAT2
  Gene Name: branched chain amino-acid transaminase 2, mitochondrial
  ENST ID: ENST00000599246
  CDS Start-End: 23-964
acagttacgcgccgcacggatcatggccgcagccgctctggggcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccaggtgagctgcagggagctggggaatgggctgggagcttgttccctggagaagttggtgtcccatgagcccctggactaacagccagcctccttcagtagtaccaggaacagataatggcctttcttattgaggccctggagagtgggctttctgtgctgctctgtggcctggaaaaccccttggggctaaatcaccctttcctgggagctcccggagccctggatatgtcttcagctttggaaaccccttcctgtgatcctctgcggctcctgggtgccctggtaggagaaaccccctctccgtgggcctctgaggcccctgggtgccctggtgggagaaactccctccctgtgatcctctgctgccccgggtgccctggtgggagaaaggccctttccatgaatcactgagaccttagccagccctctggccatctcagaggttggcctcccaagattccctggagccctgggctatccctttggccggagaaagcttcctcccatgagcctctggaccttggcccctctctggcaccagactgtttaatcccataaatctct

SEQ ID NO: 111941 - DNA, 1016 bp, Homo sapiens
  Payload ID: 1938
  Gene Symbol: BCAT2
  Gene Name: branched chain amino-acid transaminase 2, mitochondrial
  ENST ID: ENST00000601681
  CDS Start-End: 691-1016
accactggcctgcagccggtccgactcggcgccgctcctcccgccctggggttccgctgcagggcgcggaggaggatggcgccctttggaaaggagcacgaggctttaatgggaagcatggctgcaaggctgagcagtctagatgtcgccacccaaaggcaatctggggacccacgctctgatcaccccggaatccctggagcctcacaccagcaagaccacgctgcaggcccatctcccagcaactcacctagcgacaagtgaccacgcccattcacgtccatcttccagaatcagtgccaactcacccagctcacagggcaggccaggccaggccactctgtctctctcaacctcacgccccaacgcctccccacagggctggggaaagaggccttgtgaggtcaaaggtcaccagagagggcccagcctgctggacacagccagacctgctcttcctactcccctctgggaggacccgcctgagcctcatgcagtgaggactgcagtggctccccaggcccctgtagctgcccctcagccccaggggctgaagggaattggagtcactgccaaaatgggtttgtatttcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccg

SEQ ID NO: 111942 - DNA, 2103 bp, Homo sapiens
  Payload ID: 1939
  Gene Symbol: BCKDHA
  Gene Name: branched chain keto acid dehydrogenase E1, alpha polypeptide
  Uniprot ID: P12694
  ENST ID: ENST00000269980
  CDS Start-End: 369-1706
accaacaatctggctccgcccagtcccacctcctaactctggcaacgccattggacatttgggaacagaaggcaggccttggcattgatccgctttactctgggcccccgggccctaaatccctgaggccctggtcaggttgccctcttctttgcctgttacaggagtaactacaatgaggcgattggagaaaattttgggtagatagatttttttttctccaaatctctgtgcattctatctaccacagaacgggaagaagatggttttcttgtcagatggtgctggagtttgcgtcaggcacataaagaggcagccccgaatctagcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctactcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctctacca

SEQ ID NO: 111943 - DNA, 1745 bp, Homo sapiens
  Payload ID: 1939
  Gene Symbol: BCKDHA
  Gene Name: branched chain keto acid dehydrogenase E1, alpha polypeptide
  Uniprot ID: P12694
  ENST ID: ENST00000457836
  CDS Start-End: 6-1352
ccaagatggcggtagcgatcgctgcagcgagggtctggcggctaaaccgtggtttgagccagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctacagttcatcccccatcctccctcctgacccccactccagggagcccacactgacctggggccccttgcccctgtgcaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctactcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctct

SEQ ID NO: 111944 - DNA, 994 bp, Homo sapiens
  Payload ID: 1939
  Gene Symbol: BCKDHA
  Gene Name: branched chain keto acid dehydrogenase E1, alpha polypeptide
  ENST ID: ENST00000542943
  CDS Start-End: 9-994
tagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctacaggatcgggcaccacagcaccagtgacgacagttcagcgtaccgctcggtggatgaggtcaattactgggataaacagga

SEQ ID NO: 111945 - DNA, 562 bp, Homo sapiens
  Payload ID: 1939
  Gene Symbol: BCKDHA
  Gene Name: branched chain keto acid dehydrogenase E1, alpha polypeptide
  ENST ID: ENST00000544905
  CDS Start-End: 1-283
gagccaaggctggtgggatgaggagcaggagaaggcctggaggaagcagtcccgcaggaagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctcta

SEQ ID NO: 111946 - DNA, 632 bp, Homo sapiens
  Payload ID: 1939
  Gene Symbol: BCKDHA
  Gene Name: branched chain keto acid dehydrogenase E1, alpha polypeptide
  ENST ID: ENST00000541315
  CDS Start-End: 1-632
tggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcagaagcgaggcctcaccatgttgctcaggctggtctccaactcctgggctcaagcgatcctccaacgtcagcctctcaaagtgctgggattacaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggg

SEQ ID NO: 111947 - DNA, 1251 bp, Homo sapiens
  Payload ID: 1939
  Gene Symbol: BCKDHA
  Gene Name: branched chain keto acid dehydrogenase E1, alpha polypeptide
  ENST ID: ENST00000595085
  CDS Start-End: 40-1251
ctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacacagccacagggggtcccaaggcacgtgcttcagttggtccctcatctccgtcaaccacaggcacttgtgggattatgatgccattgcatgccatgggcctctggcatcctgtttcccatcagcaagagctcagcgcggcgcccaagcccaaaggcacaaccaaaccaatcctggaatcctatcttaagagtcatctcctgggacactccaggtatcaactctatatccatcaggatgcagtcaggagagaaaaaccacagagtaacttgaacagggaaagtttaatatag

SEQ ID NO: 111948 - DNA, 3692 bp, Homo sapiens
  Payload ID: 1940
  Gene Symbol: BCKDHB
  Gene Name: branched chain keto acid dehydrogenase E1, beta polypeptide
  Uniprot ID: P21953
  ENST ID: ENST00000320393
  CDS Start-End: 48-1226
aggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttttgatggtaacaaactttgatggtaaagttggtaaaaggcaactttcagaagaaaataatgtgctttagaaaaaaaattcaaatttatagtagtatatttacatttttgttgttgttgttgttctgagatggagtctcactctgtcgcccaggctagactgcagtggtgcaatctcagctcactgcaacctcccccctacccctgagttcaagcgattctcctgcctcagcctgctgagtagttgggattacaggcgcccaccaccatgcccagctaatttttgtgtttttattggaggtggggtgtcactatgttggctcagctgatttcaaattcctgacctcaagtgatccacctgccttagcctcccaaagtgctgggattacaggcatgagccactgcacctggctatatttacatttaatagaaacatatctagcatatgtatatgtgattttttttttttttttgagaccgagtctcactctgtcaccaggctggagtgcagtggtgcgatcttggctcatggcaacctctgcctcccaggttcaagcgattgtcctgcctcagtctcctgagtagctgggactacaggtgtgcaccaacatgcccagctaattttttatatttttagtagagacggggtttcaccatgttggccaggatggtctcgatctcttgaccttgtgttccacccgccttggcctcccaaagtgctggaattacaggcatgagccaccgcgcctggcctgtatatgtgatttctaaaaaatagatgcatgcatatgttaacattgaatagtcaatcactagatgaagatgctctctaccatggtttagattgcaagtgtactttataccattgtttcaacttcaacctttatttttgtatatattttttcagctacttaaactgttcatgaataggcgtactttctgtatttaaaaatggcccctcaagcaccgttaatttacattccagttatttacatgataattcatgacattctgaaacttgcctgtatattatctgaaaaatggatttcttgagcaaaagatctgtttattgtatgtaaggaaaaattttacctgaaaacaaacaaacaaaccctaaaactcagcaccactaccatttccagaagcttttttaacaagtgaatattttttacataatggataataaatggtatttattcatcatgattttctaagtaatgcttatcagccccttcagtggtgttattctaacaaaatgaatacattacaaattattaagttagcttttcagagttttaatatagaagttactagcactgacacactgattttgaaatgtttcaaaatgagtagatatgattagatcctttaccttttaatatctagtttttccaaaaatgatagtaatatcttttgaagaactatgctttttcaaaagcaaaatcaactctgtataatagcacattctctactttttaaagatcagaaatgctagaattcttgacttttgtgtatgggtagtaaatctagctcactgaaaatcagagtgaaacgcctttacatttgtgcggatagagaagttaactctccctcatatgtcactgtgctaccataatccctacattttctgtctgttctagtctaagaatattgttatagatggaagttaggaccattagcccacagatgcatgtattctctcagacataccggtgtagatgctatatttctgatgtcttcttaatgtctgtgaaagcaactggcatctacaataaatcacacttagagctggttagaggactccttcacttttgttgtccatgtggttcccttccgtggaccagccgtaataaagagccaaggtagtgatggtggccacgtgcctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaagtgaaccatcacgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtc

SEQ ID NO: 111949 - DNA, 1514 bp, Homo sapiens
  Payload ID: 1940
  Gene Symbol: BCKDHB
  Gene Name: branched chain keto acid dehydrogenase E1, beta polypeptide
  Uniprot ID: P21953
  ENST ID: ENST00000356489
  CDS Start-End: 48-1226
aggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatatagaaaagctggaagattatgactagatatggaaatattttttctgaatttttttttatatttcctccgacttacctctttttgaaaagagagtttttattaagtgaaccatcacgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaa

SEQ ID NO: 111950 - DNA, 743 bp, Homo sapiens
  Payload ID: 1940
  Gene Symbol: BCKDHB
  Gene Name: branched chain keto acid dehydrogenase E1, beta polypeptide
  Uniprot ID: P21953
  ENST ID: ENST00000369760
  CDS Start-End: 48-704
aggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaagatcaaagttataagcttatcttagttgagtagatgttgcctgatttttgaatgtgagctagaa

SEQ ID NO: 111951 - DNA, 2128 bp, Homo sapiens
  Payload ID: 1941
  Gene Symbol: BCKDK
  Gene Name: branched chain ketoacid dehydrogenase kinase
  Uniprot ID: O14874
  ENST ID: ENST00000219794
  CDS Start-End: 364-1602
ggcgtggcctggatgcgcgggcgcccgggacggcacgtcctcagaccaaactacaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgccctctcgggccccgtgtgtggggagggcaggtgaacttttgtttctgcccccattcaggttcactgagcccttgggttgaactggttcgtgtcccagtctcttacctgccctgagagcctggcaggccaggagtagaatgggtcccaagtctgttgcatgtttgatttggtgggagtgggatgactgcagcaccttatacaaagagctttcattcatcttgttgaa

SEQ ID NO: 111952 - DNA, 1907 bp, Homo sapiens
  Payload ID: 1941
  Gene Symbol: BCKDK
  Gene Name: branched chain ketoacid dehydrogenase kinase
  Uniprot ID: O14874
  ENST ID: ENST00000287507
  CDS Start-End: 364-1371
ggcgtggcctggatgcgcgggcgcccgggacggcacgtcctcagaccaaactacaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacgggtgagaccctgccaggccaggatggaggggtgggggaccccaggagactcaagcctctgaagcctcctgtcctgtccccctgcccacccccagctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgccc

SEQ ID NO: 111953 - DNA, 1997 bp, Homo sapiens
  Payload ID: 1941
  Gene Symbol: BCKDK
  Gene Name: branched chain ketoacid dehydrogenase kinase
  Uniprot ID: O14874
  ENST ID: ENST00000394950
  CDS Start-End: 364-1461
ggcgtggcctggatgcgcgggcgcccgggacggcacgtcctcagaccaaactacaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacgggtgagaccctgccaggccaggatggaggggtgggggaccccaggagactcaagcctctgaagcctcctgtcctgtccccctgcccacccccagctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgccc

SEQ ID NO: 111954 - DNA, 2164 bp, Homo sapiens
  Payload ID: 1941
  Gene Symbol: BCKDK
  Gene Name: branched chain ketoacid dehydrogenase kinase
  Uniprot ID: O14874
  ENST ID: ENST00000394951
  CDS Start-End: 624-1862
aaagaacgggtgggaatggtgtgggtgggggtcaaagaggaaacccagagatgcagggcgcccctttcccgtggtctgcccccaattgctcaggcaggccagtcacgggcacggaaagatctattcaactcactgcccaatctcctctcctggtgcagaaaagacacccagtcagcgacttgcattatctgcaggcatgagtgaataataataatgcctaacccttatatagtgctaattccacgcctggcactgttctaggcactcatataaattcatgtaatccacacaaccccaaaactgatgatatctcttcatcttaccaagcactgagcagttaaataacttgctccagatattaaggggtcgagctggggtttgaagcctggttacccataaatgaaccaagaactggaaggaggacaagagctccgagaaggagtcagatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgccc

SEQ ID NO: 111955 - DNA, 554 bp, Homo sapiens
  Payload ID: 1941
  Gene Symbol: BCKDK
  Gene Name: branched chain ketoacid dehydrogenase kinase
  ENST ID: ENST00000567676
  CDS Start-End: 291-554
gggagtggtggggagaggtcgcccgggtctggggagaccgatgcacaggtggagagatggtgcgggttctgtggattcggatccttacaacttcctcttccccgccccggtagatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctg

SEQ ID NO: 111956 - DNA, 640 bp, Homo sapiens
  Payload ID: 1941
  Gene Symbol: BCKDK
  Gene Name: branched chain ketoacid dehydrogenase kinase
  ENST ID: ENST00000561755
  CDS Start-End: 461-640
gtggggcgaccccagcctactcagtccgcggaggccccgcggcgcacgtccgcagcctccatcacagcgcgggcgcgcagacggggctggcatctaccatatggggggcatccgggccgaaccaagtgacccgcgtggggggtcccgctggggactccgtgccgcaccctcccaagccggccccaggggcccagggctggtgtcgcacgttcgctggccgcgctcccagggcccgggtttgaaggcgctgggcaggcaggggcagccccgccccctgagaaggatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgac

SEQ ID NO: 111957 - DNA, 1796 bp, Homo sapiens
  Payload ID: 1941
  Gene Symbol: BCKDK
  Gene Name: branched chain ketoacid dehydrogenase kinase
  ENST ID: ENST00000567530
  CDS Start-End: 364-1017
ggcgtggcctggatgcgcgggcgcccgggacggcacgtcctcagaccaaactacaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactc

SEQ ID NO: 111958 - DNA, 754 bp, Homo sapiens
  Payload ID: 1941
  Gene Symbol: BCKDK
  Gene Name: branched chain ketoacid dehydrogenase kinase
  ENST ID: ENST00000484226
  CDS Start-End: 105-754
cccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctc

SEQ ID NO: 111959 - DNA, 439 bp, Homo sapiens
  Payload ID: 1941
  Gene Symbol: BCKDK
  Gene Name: branched chain ketoacid dehydrogenase kinase
  ENST ID: ENST00000567682
  CDS Start-End: 1-439
atgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctcca

SEQ ID NO: 111960 - DNA, 1947 bp, Homo sapiens
  Payload ID: 1942
  Gene Symbol: BRAP
  Gene Name: BRCA1 associated protein
  ENST ID: ENST00000327551
  CDS Start-End: 142-1830
agcgccgcgggtgagtcccgcggcctcgccgcattccctgtagccgggtctgggcccggagggcttcccttcccaaagcactggcccgggaaaagcccgcggcgagggctgttgcccaggaagacacggagagccggggaaatgtctgatgaggagataaaaaagacgacactagcctcagctgtagcctgtttagaaggcaagtcaccaggagagaaagtagcgattatccatcagcatctcggccgtcgagaaatgacagatgtgatcattgagaccatgaagtccaacccagatgaactaaaaactacagtggaagaaaggaagtcttcagaagcctcccccactgcgcaaagaagtaaagatcacagtaaggaatgcataaacgctgccccagattctccgtccaaacagcttccagaccagatttcattcttcagtggaaatccatcagttgaaatagttcatggtattatgcacctatataagacaaataagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggctgatgcggatagtttttatatgacatgcaatggccgccagttcaactcaatagaagatgacgtttgccagctagtgtatgtggaaagagctgaagtgctcaaatctgaagatggcgccagcctcccagtgatggacctgactgaactccccaagtgcacggtgtgtctggagcgcatggacgagtctgtgaatggcatcctcacaacgttatgtaaccacagcttccacagccagtgtctacagcgctgggacgataccacgtgtcctgtttgccggtactgtcaaacgcccgagccagtagaagaaaataagtgttttgagtgtggtgttcaggaaaatctttggatttgtttaatatgcggccacataggatgtggacggtatgtcagtcgacatgcttataagcactttgaggaaacgcagcacacgtatgccatgcagcttaccaaccatcgagtctgggactatgctggagataactatgttcatcgactggttgcaagtaaaacagatggaaaaatagtacagtatgaatgtgagggggatacttgccaggaagagaaaatagatgccttacagttagagtattcatatttactaacaagccagctggaatctcagcgaatctactgggaaaacaagatagttcggatagagaaggacacagcagaggaaattaacaacatgaagaccaagtttaaagaaacaattgagaagtgtgataatctagagcacaaactaaatgatctcctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccaca

SEQ ID NO: 111961 - DNA, 4026 bp, Homo sapiens
  Payload ID: 1942
  Gene Symbol: BRAP
  Gene Name: BRCA1 associated protein
  Uniprot ID: Q7Z569
  ENST ID: ENST00000419234
  CDS Start-End: 195-1973
agcgacggcggccgggaggcggaagtggaggttgttgtggctccgagggctgttcgaggagctgctgctgctgaggcggcggcaactgcattgaggtggtggcggcgctgccggccccgggccgctcggcctctcggctcgccttccagcctcgcctgagcccgccggggcccgcgccggccagcgcctgccctatgagtgtgtcactggttgttatccgattggagctcgcggaacactcgcctgtccccgccggcttcggcttcagcgccgcggccggggaaatgtctgatgaggagataaaaaagacgacactagcctcagctgtagcctgtttagaaggcaagtcaccaggagagaaagtagcgattatccatcagcatctcggccgtcgagaaatgacagatgtgatcattgagaccatgaagtccaacccagatgaactaaaaactacagtggaagaaaggaagtcttcagaagcctcccccactgcgcaaagaagtaaagatcacagtaaggaatgcataaacgctgccccagattctccgtccaaacagcttccagaccagatttcattcttcagtggaaatccatcagttgaaatagttcatggtattatgcacctatataagacaaataagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggctgatgcggatagtttttatatgacatgcaatggccgccagttcaactcaatagaagatgacgtttgccagctagtgtatgtggaaagagctgaagtgctcaaatctgaagatggcgccagcctcccagtgatggacctgactgaactccccaagtgcacggtgtgtctggagcgcatggacgagtctgtgaatggcatcctcacaacgttatgtaaccacagcttccacagccagtgtctacagcgctgggacgataccacgtgtcctgtttgccggtactgtcaaacgcccgagccagtagaagaaaataagtgttttgagtgtggtgttcaggaaaatctttggatttgtttaatatgcggccacataggatgtggacggtatgtcagtcgacatgcttataagcactttgaggaaacgcagcacacgtatgccatgcagcttaccaaccatcgagtctgggactatgctggagataactatgttcatcgactggttgcaagtaaaacagatggaaaaatagtacagtatgaatgtgagggggatacttgccaggaagagaaaatagatgccttacagttagagtattcatatttactaacaagccagctggaatctcagcgaatctactgggaaaacaagatagttcggatagagaaggacacagcagaggaaattaacaacatgaagaccaagtttaaagaaacaattgagaagtgtgataatctagagcacaaactaaatgatctcctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgtaaagggtgctgactggagagctgatagaaaggcgctgcgttcgaaaaggtcttaagagttcactaacctcacattctaatgaccattttgccttcctgcttggtagaagccccaactctgctgtgcatttttccattgtatttatggagttggcgtatttgacattcagttctggggtaggtttaagatgttaagttatttcttgtaacctcaaaggtaaggttatctagcactaaagcaccaaacctctctgagggcataacagctgctttaaagagaggtttccattggctattaaggagttatgaaaactccctagcaatagtgtcatatcattatcatctcccccttcctctggggagtggaagaattgcttgaatgttatctgaaaagaggcctggtagtaaaccaggccctggctctttaccagcagtcatctcttcttgctctggggccagccaggaaaaacaaacaacccggggcacattgggtagactcagtgtaggaaaaatggtggcagctccactgtttatttttggtgacttcgtacatcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattgtgtattttgttgggtttagtattttctaaatgtttacaaaatattgggctgcatgttcaggttgcagctagagggagcttgggcagattttcaattacgctttcaagatataaccaaaagctgtttctaaatcctaaaattagaatttcaacagagccccctttagaacagtcatataacgcttgtgtgggccaacagaggggctgtgtactctctctggaaccataaatgtcaaataatttataacctgcagtaattgagcaaacttaaaataagacctgtgttggaatttagtttcttgaagaggtagagggataggttagtaagatgtattgttaaacaacaggttttagtttttgctttataattagccacaggttttcaaatgatcacatttcagaataggtttttagcctgtaattaggcctcatcccctttgacctaaatgtcttacatgttacttgttagcacatcaactgtatcactaatcaccatctgtttttgtgggatgtgctgcagcatttcccaaaaaactttacgtgtaatgttgcaaaatgaatgtactcagacattcttaatttttacttagggcagaccaactctttgagtctctcttggacttatatatacagatatcttaagagtgggaatgtaaagcataacctaattctctttcctatagagattctattttatttaaaatctatttttacactagttagaatcctgctgttttggccaagtacttgtcttgcatgtctgaccttgcagaagctggggtggatcatagcatactaatgaagagaattagaagtagtttacaaagctcgctcactcctcatttctctgtgatcccttctatccagtggccccaccaccacctgggaaaacagatttttcagtacaggtgggataaatgctctgaaaggctgtgcccagaggaatgagcaaataggcaagtgtttccaaactacttggaggtttacaaaaaatatgtcccagaaaaaaaaaaaatcttaccaagatacgtaaagaaaaaaaaatttttttttaaacagtcaaagagtcatgtttgaatttcacaaaatcacatcagacagaagttgttttcttcaggagggaaatgaaccacttaatatacccatactaccttgaacaatgaaattgaattaaaatagccaaactttgaaatta

SEQ ID NO: 111962 - DNA, 3434 bp, Homo sapiens
  Payload ID: 1943
  Gene Symbol: BAP1
  Gene Name: BRCA1 associated protein-1 (ubiquitin carboxy-terminal hydrolase)
  ENST ID: ENST00000296288
  CDS Start-End: 37-2172
cctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcagggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcc

SEQ ID NO: 111963 - DNA, 3937 bp, Homo sapiens
  Payload ID: 1943
  Gene Symbol: BAP1
  Gene Name: BRCA1 associated protein-1 (ubiquitin carboxy-terminal hydrolase)
  Uniprot ID: Q92560
  ENST ID: ENST00000460680
  CDS Start-End: 473-2662
cgctccgcccctcccctcgcagcacccgggcctagtactgcccgtcccgcccctcctctcgagcctcagcgctcagcatcgcccggaccccctcttcccttcgcccgcctcgtcccgaccctccccttcgcccccgtcccgccccgcccctccccttcgcccccgtcccgtcccgccccgcccctccccttcgcccccgtccctccccttcgcccccgtccctccgcgcgtgcgcgttcgccttcgagcgcatgcccgcatctgctgtccgacaggcggaagacgagcccagaggcggagcagggccgtcgcgccttggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctg

SEQ ID NO: 111964 - DNA, 578 bp, Homo sapiens
  Payload ID: 1943
  Gene Symbol: BAP1
  Gene Name: BRCA1 associated protein-1 (ubiquitin carboxy-terminal hydrolase)
  ENST ID: ENST00000470173
  CDS Start-End: 241-578
ctgcctgaccatcaccccctcctcttgtcgccccacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattga

SEQ ID NO: 111965 - DNA, 1654 bp, Homo sapiens
  Payload ID: 1943
  Gene Symbol: BAP1
  Gene Name: BRCA1 associated protein-1 (ubiquitin carboxy-terminal hydrolase)
  ENST ID: ENST00000469613
  CDS Start-End: 1-389
tgcagaacaccaactctgcccttaggtataaggggaagggaacagggaagccaggggcattgagcggttctgctgatgggcaactgtcagtgctgcagcccaacaccatcaacgtcttggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaa

SEQ ID NO: 111966 - DNA, 521 bp, Homo sapiens
  Payload ID: 1943
  Gene Symbol: BAP1
  Gene Name: BRCA1 associated protein-1 (ubiquitin carboxy-terminal hydrolase)
  ENST ID: ENST00000490917
  CDS Start-End: 74-199
gggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgg

SEQ ID NO: 111967 - DNA, 1234 bp, Homo sapiens
  Payload ID: 1943
  Gene Symbol: BAP1
  Gene Name: BRCA1 associated protein-1 (ubiquitin carboxy-terminal hydrolase)
  ENST ID: ENST00000478368
  CDS Start-End: 1-762
ggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaagctgcctattgctcgtggggctttgttgctggcccgccccgatcagaggtgcaatgctgggttttggcaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctg

SEQ ID NO: 111968 - DNA, 489 bp, Homo sapiens
  Payload ID: 1943
  Gene Symbol: BAP1
  Gene Name: BRCA1 associated protein-1 (ubiquitin carboxy-terminal hydrolase)
  ENST ID: ENST00000615113
  CDS Start-End: 1-489
atgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtag

SEQ ID NO: 111969 - DNA, 5499 bp, Homo sapiens
  Payload ID: 1944
  Gene Symbol: BARD1
  Gene Name: BRCA1 associated RING domain 1
  Uniprot ID: Q99728
  ENST ID: ENST00000260947
  CDS Start-End: 136-2469
cctctggcggcccgccgtcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaagtctaatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatgtggggaggttactctgctctgggtgctctcattcatgaatcgacaaggatacattagattattttgaaacatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccatatacctgtgtcttgtataaaattggcttattctgtgctgttgaatgaggctcaacatgacttggtgaggaagtctattaactaacaaaagcttatcttttttaacataatgctttttaattaattttgaataaaaatatttctaaagtgtactagatactttattaccttagattattccgaatacagtataactttgatagtttggaatagtcattaagaaacaattacacactgattgctttgtgtctctaaaagtgagaggctggtagcttttccacattctcatggctattttctagttctacttgaatttataactgtttccctttttccttgacagctgccactttgtagctatttttctgtctctgctaatactttaccatatctatctcaattgttttttcttttgacttgctgaaaaatagaaaccagatgggaagtatattagcattatgattgaaataagggtaaatgagcaatgtgtgaaggttttcactgacttcacctaaaagatagtttagctacttgaattttagtaaatagaatttttcctttatttcatcggtccccccacctttttttttttttgcacctgccttgtaaatttaatagttaagtgacctctgcctagaggatgatatttggggaggtttgatgtttcctgtgggaataagacgattcacaggtgagagtggggccacattagctgttattgtttccatgggtcagtgtggaaaatgcattaatcatattctaaacgttcatgggcctcattacagtcacaattgtctattctgtttcctaccctgaacacattaaaatggtaggaactaatgcttgtcttatttaattactaaaagccaccattttctttgatagattgagctacagattgtaaacttcatgtatttctttataagtcaacccttttcaaagatacgcacatcaaactgaatgaataaataaatattgagaagttg

SEQ ID NO: 111970 - DNA, 766 bp, Homo sapiens
  Payload ID: 1944
  Gene Symbol: BARD1
  Gene Name: BRCA1 associated RING domain 1
  ENST ID: ENST00000421162
  CDS Start-End: 119-766
tcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctg

SEQ ID NO: 111971 - DNA, 615 bp, Homo sapiens
  Payload ID: 1944
  Gene Symbol: BARD1
  Gene Name: BRCA1 associated RING domain 1
  ENST ID: ENST00000432456
  CDS Start-End: 1-134
gggtaaaagcatgtctacgaagaaaagtatgtgaacaggaagaaaagtatgaaattcctgaaggtccacgcagaagcaggctcaacagagaacagctgcacttgattctgaaagatgatcacgatgagcagtaaaatccagaagttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaa

SEQ ID NO: 111972 - DNA, 2261 bp, Homo sapiens
  Payload ID: 1944
  Gene Symbol: BARD1
  Gene Name: BRCA1 associated RING domain 1
  ENST ID: ENST00000455743
  CDS Start-End: 105-335
agagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtc

SEQ ID NO: 111973 - DNA, 5449 bp, Homo sapiens
  Payload ID: 1944
  Gene Symbol: BARD1
  Gene Name: BRCA1 associated RING domain 1
  Uniprot ID: Q99728
  ENST ID: ENST00000617164
  CDS Start-End: 143-2419
ccccgcccctctggcggcccgccgtcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaagtctaatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatgtggggaggttactctgctctgggtgctctcattcatgaatcgacaaggatacattagattattttgaaacatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccatatacctgtgtcttgtataaaattggcttattctgtgctgttgaatgaggctcaacatgacttggtgaggaagtctattaactaacaaaagcttatcttttttaacataatgctttttaattaattttgaataaaaatatttctaaagtgtactagatactttattaccttagattattccgaatacagtataactttgatagtttggaatagtcattaagaaacaattacacactgattgctttgtgtctctaaaagtgagaggctggtagcttttccacattctcatggctattttctagttctacttgaatttataactgtttccctttttccttgacagctgccactttgtagctatttttctgtctctgctaatactttaccatatctatctcaattgttttttcttttgacttgctgaaaaatagaaaccagatgggaagtatattagcattatgattgaaataagggtaaatgagcaatgtgtgaaggttttcactgacttcacctaaaagatagtttagctacttgaattttagtaaatagaatttttcctttatttcatcggtccccccacctttttttttttttgcacctgccttgtaaatttaatagttaagtgacctctgcctagaggatgatatttggggaggtttgatgtttcctgtgggaataagacgattcacaggtgagagtggggccacattagctgttattgtttccatgggtcagtgtggaaaatgcattaatcatattctaaacgttcatgggcctcattacagtcacaattgtctattctgtttcctaccctgaacacattaaaatggtaggaactaatgcttgtcttatttaattactaaaagccaccattttctttgatagattgagctacagattgtaaacttcatgtatttctttataagtcaacccttttcaaagatacgcacatcaaactgaatgaataaataaatattgagaagttg

SEQ ID NO: 111974 - DNA, 1456 bp, Homo sapiens
  Payload ID: 1944
  Gene Symbol: BARD1
  Gene Name: BRCA1 associated RING domain 1
  Uniprot ID: Q99728
  ENST ID: ENST00000620057
  CDS Start-End: 74-457
cagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctg

SEQ ID NO: 111975 - DNA, 3967 bp, Homo sapiens
  Payload ID: 1944
  Gene Symbol: BARD1
  Gene Name: BRCA1 associated RING domain 1
  ENST ID: ENST00000619009
  CDS Start-End: 143-937
ccccgcccctctggcggcccgccgtcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcaggggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaagtctaatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatgtggggaggttactctgctctgggtgctctcattcatgaatcgacaaggatacattagattattttgaaacatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccatatacctgtgtcttgtataaaattggcttattctgtgctgttgaatgaggctcaacatgacttggtgaggaagtctattaactaacaaaagcttatcttttttaacataatgctttttaattaattttgaataaaaatatttctaaagtgtactagatactttattaccttagattattccgaatacagtataactttgatagtttggaatagtcattaagaaacaattacacactgattgctttgtgtctctaaaagtgagaggctggtagcttttccacattctcatggctattttctagttctacttgaatttataactgtttccctttttccttgacagctgccactttgtagctatttttctgtctctgctaatactttaccatatctatctcaattgttttttcttttgacttgctgaaaaatagaaaccagatgggaagtatattagcattatgattgaaataagggtaaatgagcaatgtgtgaaggttttcactgacttcacctaaaagatagtttagctacttgaattttagtaaatagaatttttcctttatttcatcggtccccccacctttttttttttttgcacctgccttgtaaatttaatagttaagtgacctctgcctagaggatgatatttggggaggtttgatgtttcctgtgggaataagacgattcacaggtgagagtggggccacattagctgttattgtttccatgggtcagtgtggaaaatgcattaatcatattctaaacgttcatgggcctcattacagtcacaattgtctattctgtttcctaccctgaacacattaaaatggtaggaactaatgcttgtcttatttaattactaaaagccaccattttctttgatagattgagctacagattgtaaacttcatgtatttctttataagtcaacccttttcaaagatacgcacatcaaactgaatgaataaataaatattgagaagttg

SEQ ID NO: 111976 - DNA, 703 bp, Homo sapiens
  Payload ID: 1944
  Gene Symbol: BARD1
  Gene Name: BRCA1 associated RING domain 1
  ENST ID: ENST00000613192
  CDS Start-End: 200-703
agacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttggggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctga

SEQ ID NO: 111977 - DNA, 4096 bp, Homo sapiens
  Payload ID: 1944
  Gene Symbol: BARD1
  Gene Name: BRCA1 associated RING domain 1
  ENST ID: ENST00000613374
  CDS Start-End: 143-1066
ccccgcccctctggcggcccgccgtcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaagtctaatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatgtggggaggttactctgctctgggtgctctcattcatgaatcgacaaggatacattagattattttgaaacatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccatatacctgtgtcttgtataaaattggcttattctgtgctgttgaatgaggctcaacatgacttggtgaggaagtctattaactaacaaaagcttatcttttttaacataatgctttttaattaattttgaataaaaatatttctaaagtgtactagatactttattaccttagattattccgaatacagtataactttgatagtttggaatagtcattaagaaacaattacacactgattgctttgtgtctctaaaagtgagaggctggtagcttttccacattctcatggctattttctagttctacttgaatttataactgtttccctttttccttgacagctgccactttgtagctatttttctgtctctgctaatactttaccatatctatctcaattgttttttcttttgacttgctgaaaaatagaaaccagatgggaagtatattagcattatgattgaaataagggtaaatgagcaatgtgtgaaggttttcactgacttcacctaaaagatagtttagctacttgaattttagtaaatagaatttttcctttatttcatcggtccccccacctttttttttttttgcacctgccttgtaaatttaatagttaagtgacctctgcctagaggatgatatttggggaggtttgatgtttcctgtgggaataagacgattcacaggtgagagtggggccacattagctgttattgtttccatgggtcagtgtggaaaatgcattaatcatattctaaacgttcatgggcctcattacagtcacaattgtctattctgtttcctaccctgaacacattaaaatggtaggaactaatgcttgtcttatttaattactaaaagccaccattttctttgatagattgagctacagattgtaaacttcatgtatttctttataagtcaacccttttcaaagatacgcacatcaaactgaatgaataaataaatattgagaagttg

SEQ ID NO: 111978 - DNA, 4153 bp, Homo sapiens
  Payload ID: 1944
  Gene Symbol: BARD1
  Gene Name: BRCA1 associated RING domain 1
  ENST ID: ENST00000613706
  CDS Start-End: 143-1123
ccccgcccctctggcggcccgccgtcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaagtctaatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatgtggggaggttactctgctctgggtgctctcattcatgaatcgacaaggatacattagattattttgaaacatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccatatacctgtgtcttgtataaaattggcttattctgtgctgttgaatgaggctcaacatgacttggtgaggaagtctattaactaacaaaagcttatcttttttaacataatgctttttaattaattttgaataaaaatatttctaaagtgtactagatactttattaccttagattattccgaatacagtataactttgatagtttggaatagtcattaagaaacaattacacactgattgctttgtgtctctaaaagtgagaggctggtagcttttccacattctcatggctattttctagttctacttgaatttataactgtttccctttttccttgacagctgccactttgtagctatttttctgtctctgctaatactttaccatatctatctcaattgttttttcttttgacttgctgaaaaatagaaaccagatgggaagtatattagcattatgattgaaataagggtaaatgagcaatgtgtgaaggttttcactgacttcacctaaaagatagtttagctacttgaattttagtaaatagaatttttcctttatttcatcggtccccccacctttttttttttttgcacctgccttgtaaatttaatagttaagtgacctctgcctagaggatgatatttggggaggtttgatgtttcctgtgggaataagacgattcacaggtgagagtggggccacattagctgttattgtttccatgggtcagtgtggaaaatgcattaatcatattctaaacgttcatgggcctcattacagtcacaattgtctattctgtttcctaccctgaacacattaaaatggtaggaactaatgcttgtcttatttaattactaaaagccaccattttctttgatagattgagctacagattgtaaacttcatgtatttctttataagtcaacccttttcaaagatacgcacatcaaactgaatgaataaataaatattgagaagttg

SEQ ID NO: 111979 - DNA, 6048 bp, Homo sapiens
  Payload ID: 1945
  Gene Symbol: BRIP1
  Gene Name: BRCA1 interacting protein C-terminal helicase 1
  Uniprot ID: Q9BX63
  ENST ID: ENST00000259008
  CDS Start-End: 269-4018
aattcgtctcgggttgtgtggttgaggggtctggtgggtcgaggaaaggtaacggcggccccagtcctgcacacaaggccggggaagtagcagcacccccaggaagagggaggaggaagggctcgtgccctttcttctcttccagggctccgctttatttgctctcagaagtcggtttcctttccttttcttcagtgaatcggagctcagagcgttgcttcggtttccctccagacagttaggaatctgaaataaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaagactcccctgaaaaaaccactctggctgcaaagttatctgctaagaaacaggcatccatatacagagatgaaaatgatgattttcaagtagagaagaaaagaattcgacccttagaaactacacagcagattagaaaacgtcattgctttggaacagaagtacacaatttggatgcaaaagttgattcaggaaagactgtaaaactcaactctccactggaaaagataaactccttttcgccacagaaaccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaattggttagaagcaaacgctgaatatcttgtagaaagagattatgaatcagcttgtaaaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacaggttgaactaaaacgacaatacaatgaccaccattcaaaattgagaggtcttctacctggccgtcagtggtatgaaattcaagcatacagggccttaaaccaggcccttggtagatgtattagacacagaaatgattggggagctcttattctagtggatgatcgctttaggaataacccaagtcgctatatatctggactttctaaatgggtacggcagcagattcagcaccattcaacctttgaaagtgcactggaatccttggctgaattttccaaaaagcatcaaaaagttcttaatgtatccataaaggacagaaccaatatacaggacaatgagtctacacttgaagtgacctctttaaagtacagtacctcaccttatttactggaagcagcaagtcatctatcaccagaaaattttgtggaagatgaagcaaagatatgtgtccaggaactacagtgtcctaaaattattaccaaaaattcacctctaccaagtagcattatctccagaaaggagaaaaatgatccagtattcctggaagaagcagggaaagcagaaaaaattgtgatttccagatccacaagcccaactttcaacaaacaaacaaagagagttagctggtcaagctttaattctttgggacagtattttactggtaaaataccgaaggcaacacctgagctcgggtcatcagagaatagtgcctctagtcctccccgtttcaaaacagagaagatggaaagtaaaactgttttgcccttcactgataaatgtgaatcctcaaatctgacagtaaacacatcgtttggatcatgccctcaatcagaaaccattatttcatcattaaagattgatgccacccttactagaaaaaatcattctgaacatccgctctgttctgaagaagccctggatccagacattgaattgtctctagtaagtgaagaagataaacagtccacttcaaatagagattttgaaacagaagcagaagatgaatctatctattttacacctgaactttatgatcctgaagatacagatgaagaaaaaaatgacctagctgaaactgatagaggaaatagattggctaacaattcagattgcattttagctaaagacctttttgaaattagaactataaaagaagtagattcagccagagaagtgaaagctgaggattgcatagatacaaagttgaatggaattctgcatattgaagaaagtaaaattgatgacattgatggtaatgtaaaaacaacttggataaatgaactggaactgggaaaaactcatgaaatagaaataaagaactttaaaccatctccttccaaaaataaaggcatgtttcctggttttaagtaataatacttaactctcaagctaagtaaaaatatgtcatcatgcttatgttaaactctgttgtaagtaataatttgtaaattgaataagtggcatactttttaaaaaactattttatgttcagaaatgtaaatgttattattcttgagtttttgggtttttttttttgagacagagtcttggtctgttgcccaggctggaatgcagtggtgtgctctgggctcactgcaaccttcacctccaggttcaagtgattctcctgcctcagccttctgagtagctgggactacaggtgtgcaccaccatgcccagctagtttttgtatttttagtagagatggggtttcaccatgttggccaggctggtctcgaactcctggcctcgtgatctgcccttctctgcctccctaagttgctgggattacaggtgtgagccacagtgcctggcccattcttgagttttgataaagtaattcatacaaagtactgtcctcaaataagtcttccttagctaaatgcaatttaaaattattcaaagatcctagggcacttctagtttcacgtaaatattcatattaggtggttctcttcatccatttgttttcacactgatacataaaaattaacagcagtctaatctagtgacacctcagtcatatttcgctatagattttacctcaaatcagtccaagactttttcagagatcaccatttgtcttgaaaggtttatttcgttattaaactgcctacttataagtaattaagagaaattaagaaagtagtatgcatttttaattgaaattgttttacattctttgtataataaacctaaaaccaaacatgtcataaacaaattgacgtaaagatataaaatgccaaatgaagtattccaaattttctattctaattatttagcttcaccatcattgtggaaaaaaatactagatcctgcttagtattatatatttttcctagtggatcagtgagtaataagtaccaaacactagactagaaggtaatttctacattgtttagaaagggtgaaacaatttatcccctctggtattgttctagcataagctttagttatacaatgattaagatagaaaacttcatatataaatttgataagcaaacccacatttatagctgcagctaaaatatgtttccttagggcacagtaatcctttctgtgaattttgaccttgtttgtgtttttgtgaatgaagctatatgtctaatcaaaaatgattataaaagaggctcatctctgacatcattccaaaaatacattcattgatctctttttaagaaacatctgttattcactgggcattgggactttttgtgagtaatttgaattgaaattttatgagctatccaagaattctgtatggtctattattttcaagtcaaaatttccagtaaggatttactttacatttcatttggataaatgaatcattatataggtatgtctttgcttccattttgagacatttagatttttacagcctgtttctatagcatttgatgttacaactctaagcgtagttcaaagacatttaaattgacaagttaccagttaaagaatttagaatatattagatcccatctagtattatatattttttctagttgatcattgagcagtaaataccaaatactcgattagaaggtaatttttacattgttttgaaagggtgaaacaatttatctcctctggtattattcttaaaccacagatagggatagtagggtagtgaaacgaataaatacctggtagaagacaagagacttgggctctacacctggctctgccactgatttgctaagtcatattggcaatcaccacacccttcagggaattagtttcatctgtaaaatgcagcggttagtactataaaatcatacaaatttctttgtgctttgagaatctataaaggaatgtctgttgatattctgagtcgattttcatttgcttttgttccagaacggttaaaataaagcatattatttcatttaaaaagtaaa

SEQ ID NO: 111980 - DNA, 466 bp, Homo sapiens
  Payload ID: 1945
  Gene Symbol: BRIP1
  Gene Name: BRCA1 interacting protein C-terminal helicase 1
  ENST ID: ENST00000577913
  CDS Start-End: 258-466
tcctttccttttcttcagtgaatcggagctcagagcgttgcttcggtttccctccagacagcttttttcttctaactggaggactgcagaaaggggtaacacaaaggggaagaactggagaaagagtgatgctacggagttgtagagagagaggcctcaggaacttatttgtttctgtaggttgattacatctgatctaactgttacaagagctcatgtttaatctgttaggaatctgaaataaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaa

SEQ ID NO: 111981 - DNA, 716 bp, Homo sapiens
  Payload ID: 1945
  Gene Symbol: BRIP1
  Gene Name: BRCA1 interacting protein C-terminal helicase 1
  ENST ID: ENST00000584322
  CDS Start-End: 1-542
aagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacagttaaccagtgctactgctgagggcactaatggctatgcccaaagctgggtctcctattctaaaatggctgatgctgccttgactacagctactgatgaaacagttgacatctacccaagaaatctactgtcaccatcaacagcattggtgctgcattccactgaagtagagtgctactgatggcactgctgttggtactggtattgtctccttttaatgtcttatcattttactctagctctacattattgcactaaggctgctttgttaaagtggaaagaatccttttcccttctttagaccacatcttcttccaatatcttaataaaatacaattttgttccctaaaactaa

SEQ ID NO: 111982 - DNA, 790 bp, Homo sapiens
  Payload ID: 1945
  Gene Symbol: BRIP1
  Gene Name: BRCA1 interacting protein C-terminal helicase 1
  ENST ID: ENST00000579028
  CDS Start-End: 1-254
aaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagagatgagatctcactatgttgatcaggatggtcttgaactcctggcctcaagtgatcctcccacctcagcctcccaaagtgctaggattatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaag

SEQ ID NO: 111983 - DNA, 3969 bp, Homo sapiens
  Payload ID: 1945
  Gene Symbol: BRIP1
  Gene Name: BRCA1 interacting protein C-terminal helicase 1
  ENST ID: ENST00000577598
  CDS Start-End: 1-2985
atgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaagactcccctgaaaaaaccactctggctgcaaagttatctgctaagaaacaggcatccatatacagagatgaaaatgatgattttcaagtagagaagaaaagaattcgacccttagaaactacacagcagattagaaaacgtcattgctttggaacagaagtacacaatttggatgcaaaagttgattcaggaaagactgtaaaactcaactctccactggaaaagataaactccttttcgccacagaaaccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaattggttagaagcaaacgctgaatatcttgtagaaagagattatgaatcagcttgtaaaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacaggttgaactaaaacgacaatacaatgaccaccattcaaaattgagaggtcttctacctggccgtcagtggtatgaaattcaagcatacagggccttaaaccaggcccttggtagatgtattagacacagaaatgattggggagctcttattctagtggatgatcgctttaggaataacccaagtcgctatatatctggactttctaaatgggtacggcagcagattcagcaccattcaacctttgaaagtgcactggaatccttggctgaattttccaaaaagcatcaaaaagttcttaatgtatccataaaggacagaaccaatatacaggacaatgagtctacacttgaagtgacctctttaaagtacagtacctcaccttatttactggaagcagcaagtcatctatcaccagaaaattttgtggaagatgaagcaaagatatgtgtccaggaactacagtgtcctaaaattattaccaaaaattcacctctaccaagtagcattatctccagaaaggagaaaagtatgaaaagttcttcccatttacctttgatagagaagtctttcattatatttagtgaaatgatatttatttgggtatagattaattccttaaatatggtggtttgtaatataaggtgttatcataaaatagtgaaacagtatggtgtactgtaatgggaacaaacttttgtcaggagaccagagcatattttctggttttccactaactggctttgccacttactagctttgtgatcatgagcaagtcatttgtcctttttgagtcgtaataggaaaaaaaaaatgcctgcctagctatcccttcaggttgggttgtaaaggtcaaaattataaatatcacagcattgtaaagtaccatgtaagtggtagatgttattctaaaggctatataaaaatttggcctaatttttatgtagatacttctatatgaactacttttcctatatagatagttcttatgaacttatttttaggaggtgagagacatttattttaagtgatgaaaaataatattttaaaatattttgaaataatcatctgtatcagattggcaaactgtggcccatgggccaaatttggcctgctgcctgtttttgtaaataaagtttaatgaaatgtagtcatgcccatttatttacattttagaaacaacagcagagttgagtatttgtgtgtattgcactagaacagcataattgagtagtcgcaacagatacattatgctccacaaagcctaaatattactatctggcctatgacagaaaaggtttgccaaactctggtctattccattggatataatttcagttgttttaattcatatatccaaggcgggtggatcatccgaggtcaggagtccgagaccagcctgaccagtgtggtgaaacaccgtctctactaaaaaaatacaaaaattagctgggtgtggaggcagctgtctgtaatcccagctactcaggaggctgaggcaggagaattgcttgaactgggaggtggaggttgcagtgagccaggattgcgccattgcactccagcctgggcaacaaaagcaaaactcggact

SEQ ID NO: 111984 - DNA, 2496 bp, Homo sapiens
  Payload ID: 1946
  Gene Symbol: BRCC3
  Gene Name: BRCA1/BRCA2-containing complex, subunit 3
  Uniprot ID: P46736
  ENST ID: ENST00000330045
  CDS Start-End: 98-973
gagcgcacagcgctgggcgctggggaggctgcgccgcagcacccggttggtcaggaccaagtgggcccgaggcggacgtgagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaa

SEQ ID NO: 111985 - DNA, 1101 bp, Homo sapiens
  Payload ID: 1946
  Gene Symbol: BRCC3
  Gene Name: BRCA1/BRCA2-containing complex, subunit 3
  Uniprot ID: P46736
  ENST ID: ENST00000340647
  CDS Start-End: 109-987
aggcctgggcggagcgcacagcgctgggcgctggggaggctgcgccgcagcacccggttggtcaggaccaagtgggcccgaggcggacgtgagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaagtaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttac

SEQ ID NO: 111986 - DNA, 2641 bp, Homo sapiens
  Payload ID: 1946
  Gene Symbol: BRCC3
  Gene Name: BRCA1/BRCA2-containing complex, subunit 3
  Uniprot ID: P46736
  ENST ID: ENST00000369459
  CDS Start-End: 30-773
gaggcggacgtgagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagaccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgagtctttacctgtgctgaagttgtatggacctacatacacacaaatgaatgcatgtaaaatctggtgatactgaataaagtctgtggtctagatagcag

SEQ ID NO: 111987 - DNA, 2846 bp, Homo sapiens
  Payload ID: 1946
  Gene Symbol: BRCC3
  Gene Name: BRCA1/BRCA2-containing complex, subunit 3
  Uniprot ID: P46736
  ENST ID: ENST00000369462
  CDS Start-End: 26-976
cggacgtgagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtcccttcatggtccacgagacttctggagctccagccagcacatctccattgagggccagaaggaagaggaaaggtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgagtctttacctgtgctgaagttgtatggacctacatacacacaaatgaatgcatgtaaaatctggtgatactgaataaagtctgtggtctagatagcagta

SEQ ID NO: 111988 - DNA, 456 bp, Homo sapiens
  Payload ID: 1946
  Gene Symbol: BRCC3
  Gene Name: BRCA1/BRCA2-containing complex, subunit 3
  ENST ID: ENST00000399026
  CDS Start-End: 1-273
atgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttggtaagtatcatggggttgcaatgtttattgttttcagaaattaatatcatgtttccttttccattacatagggtatggttattttaaaccaaaatttgactgtcctttagcagatgtcattattttgatttattttattatgtattaaaagtaatgatttatgtcatattgattgtttttaataagtctgtcagttgatataaaaaaattaaactgttaactgaaaa

SEQ ID NO: 111989 - DNA, 954 bp, Homo sapiens
  Payload ID: 1946
  Gene Symbol: BRCC3
  Gene Name: BRCA1/BRCA2-containing complex, subunit 3
  ENST ID: ENST00000399042
  CDS Start-End: 1-954
atggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagagacacacaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtcccttcatggtccacgagacttctggagctccagccagcacatctccattgagggccagaaggaagaggaaaggtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagaagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataa

SEQ ID NO: 111990 - DNA, 688 bp, Homo sapiens
  Payload ID: 1946
  Gene Symbol: BRCC3
  Gene Name: BRCA1/BRCA2-containing complex, subunit 3
  ENST ID: ENST00000411985
  CDS Start-End: 11-688
tcgggccaagatggcggtgcaggtggtgcaggcggtgcaggcggttcatctcgagtctgacgctttcctcgtttgtctcaaccacgctctgagcacagagaaggaggaagtaatggggctgtgcataggggaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtcccttcatggtccacgagacttctggagctccagccagcacatctccattgagggccagaaggaagaggaaaggtatgagagaatcgaaatcccaatccatattgtacctcatgtcactatcgggaaagtgtgccttgaatcagcagtagagctgcccaagatcctgtgccaggaggagcaggatgcgtataggaggatc

SEQ ID NO: 111991 - DNA, 2694 bp, Homo sapiens
  Payload ID: 1946
  Gene Symbol: BRCC3
  Gene Name: BRCA1/BRCA2-containing complex, subunit 3
  ENST ID: ENST00000453705
  CDS Start-End: 1-257
cggtgcaggtggtgcaggcggtgcaggcggttcatctcgagtctgacgctttcctcgtttgtctcaaccacgctctgagcacagagaaggaggaagtaatggggctgtgcataggggaggtgataggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgagtctttacctgtgctgaagttgtatggacctacatacacacaaatgaatgcatgtaaaatct

SEQ ID NO: 111992 - DNA, 882 bp, Homo sapiens
  Payload ID: 1946
  Gene Symbol: BRCC3
  Gene Name: BRCA1/BRCA2-containing complex, subunit 3
  ENST ID: ENST00000620502
  CDS Start-End: 1-882
atggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaagtaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagagacacacaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagaagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataa

SEQ ID NO: 111993 - DNA, 954 bp, Homo sapiens
  Payload ID: 1946
  Gene Symbol: BRCC3
  Gene Name: BRCA1/BRCA2-containing complex, subunit 3
  ENST ID: ENST00000630295
  CDS Start-End: 1-954
atggcggtgcaggtggtgcaggcggtgcaggcggttcatctcgagtctgacgctttcctcgtttgtctcaaccacgctctgagcacagagaaggaggaagtaatggggctgtgcataggggaggtgagtagtcccagtaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagagacacacaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtcccttcatggtccacgagacttctggagctccagccagcacatctccattgagggccagaaggaagaggaaaggtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagaagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataa

SEQ ID NO: 111994 - DNA, 2915 bp, Homo sapiens
  Payload ID: 1947
  Gene Symbol: BRAT1
  Gene Name: BRCA1-associated ATM activator 1
  Uniprot ID: Q6PJG6
  ENST ID: ENST00000340611
  CDS Start-End: 258-2723
tggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacggaagccctgtgggtgcggctgagtccccgcgtggcctgtctgctggagagagaccccatccccgccgcacactcgttcgtggacctgcttctctgtgtggctcgttctcccgtgttcagttcttccgacggcagcctgtgggagacagtggcgcgggctctgagctgcctgggtcccacccacatgggacccctggctttggggatcctgaagctcgagcactgtccacaggcactgaggacccaggccttccaggtccttctccagcccctggcctgtgtcctgaaggccacggttcaggcccccggacccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgagacctggactgggaggtccgcgcccagggcctggagctggccctcgtgttcctgggccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaa

SEQ ID NO: 111995 - DNA, 823 bp, Homo sapiens
  Payload ID: 1947
  Gene Symbol: BRAT1
  Gene Name: BRCA1-associated ATM activator 1
  ENST ID: ENST00000421712
  CDS Start-End: 18-524
gggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcaggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacggaagccctgtgggtgcggctgagtccccgcgtggcctgtctgctggagagagaccccatccccgccgcacactcgttcgtggacctgcttctctgtgtggctcgttctcccgtgttcagttcttccgacggcagcctgtgggagacagtggcgcgggctctgagctgcctgggtcccacccacatgggacccctggctttggggatcctgaagctcgagcactgtccacaggcactgaggacccaggccttccag

SEQ ID NO: 111996 - DNA, 1236 bp, Homo sapiens
  Payload ID: 1948
  Gene Symbol: BCCIP
  Gene Name: BRCA2 and CDKN1A interacting protein
  Uniprot ID: Q9P287
  ENST ID: ENST00000278100
  CDS Start-End: 13-957
gtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgagaaggcaattctcaagttcaactactcagtgcaggaggagagcgacacttgtctgggaggcaaatggtcttttgatgacgtaccaatgacgcccttgcgaactgtgatgttaattccaggcgacaagatgaacgaaatcatggataaactgaaagaatatctatctgtctaacccatttccaatggacagtgatgggcttgtttttgtaaaattaccagaaaactcagtggagatttactgaaaaactcagactttattcagattaagttcctctacaaaaagtagggttctgtcccatgtgtctctgacacatttacaaaataccagttttttaaaattttggtcaaattatgagtggttgatttaaaaacttttccaagaagaagaaaagcatggagtagtaatttaaagaactcaataaaaacttctattttttattttaaaataata

SEQ ID NO: 111997 - DNA, 2337 bp, Homo sapiens
  Payload ID: 1948
  Gene Symbol: BCCIP
  Gene Name: BRCA2 and CDKN1A interacting protein
  Uniprot ID: Q9P287
  ENST ID: ENST00000299130
  CDS Start-End: 13-891
gtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgaggagcagggaaaacctgaggtgcttggaggtccagacacaagaagaggattggaaccagttccgatacagcacaatggttggtctgttcccccagtattagaataaattaaaacatacaagccaggatgaatgaagccaataggaaataaaaaacaggcacacaacattatttggggaaaaacacctctagtgacacattttcttcatctgcactgattatttcagcaaaagaaatctagtatgttttcatacatctgatgtataaatttgctgaactttgagttagttttcttaagataatttttcatattaagaaaattttccttttctaacctattaaaatacctcactatcatttcaaaaggttaaatgagttgatcactatctctgctctgtgctcctcaaaatataatttcaaatggatccgatctaaatctatacctagtgcagatttgcaaaaaaagaaaaggaatagtcattaaggatacctgttaccatggctgcgattgttagcacttcatctacacagtcaaattcacaggacgctaagatagacttcgagagttgtggatcaagaggaaactctgacatgatgattccaaattcagaaagatttccatcattatccagtgctgccagataatctaagtcttccaatgcctgcatcaaactttctggtgctaggaaaggaaaaaaataataatttaagagtctcatatggctaagatggagaaacaggtactggacttttccctcctgcatgaaacaagcaaacaatggacaaaatatgtgaaacaacggtttgcaagccaccaaataccagggagtgaaggatagtgattcttgagagggcaaactcaggaggggagccctgtgattgtccagctcatgctccgaggagggtcccagctgcagtgtgcatgcggggggaacccaggtggagcctgccagcctccctgcagtaggaaaacaatgccagggatccagggagactaaggtggccggaactcgcggtcacagtactggagagagacacacagatctaagtcgggggccagagggagctccctcaactaggcagcacagccctactgatcagcgcatgtgtgtaaggaaccacctcaggccagagaaagagccatgtgagaagattagaaggaacagtggtgctgacacaggacctagggtagggcctgttcccaccaccctagctggaaaacctcatgatttatggggcactgggtagaaaacacaagtgagaaaccctagatgggcactgccacctgacacagctatacagcaggacctgaaaggatcacactgcatcctaggacaaagctcaaaagtacctctgggactacaaaaatattcagtgcccaagaaggtaaaatgtacaatgtctagcatccagtagagaggcatgaaaagcaggaaaatacattgcataatacagagaaaaattaatcacaactgacctggatctcagatgctagaaatagtagacaaagatgttatttcccagtgcaaataaagaaataaagatagcaagct

SEQ ID NO: 111998 - DNA, 1433 bp, Homo sapiens
  Payload ID: 1948
  Gene Symbol: BCCIP
  Gene Name: BRCA2 and CDKN1A interacting protein
  Uniprot ID: Q9P287
  ENST ID: ENST00000368759
  CDS Start-End: 13-981
gtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgaggagcagggaaaacctgaggtgcttggaggtccagacacaagaagaggattggaaccagttccgatacagcacaatggtggttcacgggggcaagtgacagccctggtttctctgaaggctggactaattcaatcaagatcaactctaagtgatttccagggaaccttcatgactgttggaattgctctgtcataataagtcagggatatttaggaggctcatagtctcctggagggataaaacatctcggcacctagtaatggtaaattagtcaatatttgttagtttcgtttgagatctcaaatgttaggattttctgaagtctcagtgtctttcagagtttgagataccttgttttcattttttctaatttttaatttaaaagtaataaagaatattttgtaatgattaggatgaaaattttatcgtcaattataagccaaaatttgctaaaattaaagtcagtatacttgaaacaagtttctagtaagttctctggggtaagatactaattactctgataaaggggctatcaaaaaaatccagtaaattgttcataagaagagatcagtttaagagtcaaacaatttgctttgctagtaccttagctaaagaaaaaatactattaaagatgactatcaccttta

SEQ ID NO: 111999 - DNA, 7082 bp, Homo sapiens
  Payload ID: 1949
  Gene Symbol: BCR
  Gene Name: breakpoint cluster region
  Uniprot ID: P11274
  ENST ID: ENST00000305877
  CDS Start-End: 752-4567
ttccaggactgcagaactggcccagacctctgtattggaaaggtctttatggaccagggagtccggtgtcttttttacgggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcggacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcggagtccaggcctggccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacactccacttctaacagggtttgagaggcttagtcagcactgggtagcgttttgactccattcttggctttctttttctttccagaaggatttttgtgcagaaatgggtcttttgttgccatgttagtcctccttggaaggcagctcagaaggcctgtgaaatgtcaggggacaggacccccagggagggaaccccaggctacgcactttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaataaccttttgatacttgaatatttgtaagttttatacatagtttctaatttttttccgaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacacctgcgggggagcccaggcattctttgtaaaccctcctgaccacctggctcaaagaaaacagaagcatggagaccgccaagtattttcaagaaataaccccatgaatattccatcacttttttagaaagaggggcttggggcaggcagaggagagaagggagagcaaactgagagccaagtttccacacggtcctgcaggaggagaggatgcagctgcccagagggaagcaggatcacatttaaggaagtgtgtggggtccctggatgacaccagcacccagtgcggctctgtctggcacccgctcccaaggtgggaggagtgggtgtcccctgtgtgtcagtgggcagctcctgctgaacccgcagctcactagggagcctgacagtggggccatgcgcctgacactcctctctgcttgtggacctggcaaggcagggagcagaaaacagccacttgaaggctttctgtctgcgtctgtgtgcagtgtggatttagttgtgcttttttcttgctgggagagcacagccaccatttacaagcagtgtcaccgtcgtgggtggcgaggacagaacaggagcctctgctctctgtacctatctgggcccggtgggctcccttgtcctggcttccatctctgtctcagcgaccattcagccctgcgcaggaacacgtgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccacctcctgcctcaacagcctgtgtggtggcaaagccggtgtggggctggggaacgcagcgttctccaggagggggacctggctctccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacga

SEQ ID NO: 112000 - DNA, 4708 bp, Homo sapiens
  Payload ID: 1949
  Gene Symbol: BCR
  Gene Name: breakpoint cluster region
  Uniprot ID: P11274
  ENST ID: ENST00000359540
  CDS Start-End: 597-4280
ggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcggacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcggagtccaggcctggccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttca

SEQ ID NO: 112001 - DNA, 5027 bp, Homo sapiens
  Payload ID: 1949
  Gene Symbol: BCR
  Gene Name: breakpoint cluster region
  ENST ID: ENST00000398512
  CDS Start-End: 1-1398
atggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcggacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcggagtccaggcctggccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacactccacttctaacagggtttgagaggcttagtcagcactgggtagcgttttgactccattcttggctttctttttctttccagaaggatttttgtgcagaaatgggtcttttgttgccatgttagtcctccttggaaggcagctcagaaggcctgtgaaatgtcaggggacaggacccccagggagggaaccccaggctacgcactttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaataaccttttgatacttgaatatttgtaagttttatacatagtttctaatttttttccgaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacacctgcgggggagcccaggcattctttgtaaaccctcctgaccacctggctcaaagaaaacagaagcatggagaccgccaagtattttcaagaaataaccccatgaatattccatcacttttttagaaagaggggcttggggcaggcagaggagagaagggagagcaaactgagagccaagtttccacacggtcctgcaggaggagaggatgcagctgcccagagggaagcaggatcacatttaaggaagtgtgtggggtccctggatgacaccagcacccagtgcggctctgtctggcacccgctcccaaggtgggaggagtgggtgtcccctgtgtgtcagtgggcagctcctgctgaacccgcagctcactagggagcctgacagtggggccatgcgcctgacactcctctctgcttgtggacctggcaaggcagggagcagaaaacagccacttgaaggctttctgtctgcgtctgtgtgcagtgtggatttagttgtgcttttttcttgctgggagagcacagccaccatttacaagcagtgtcaccgtcgtgggtggcgaggacagaacaggagcctctgctctctgtacctatctgggcccggtgggctcccttgtcctggcttccatctctgtctcagcgaccattcagccctgcgcaggaacacgtgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccacctcctgcctcaacagcctgtgtggtggcaaagccggtgtggggctggggaacgcagcgttctccaggagggggacctggctctccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacga

SEQ ID NO: 112002 - DNA, 771 bp, Homo sapiens
  Payload ID: 1949
  Gene Symbol: BCR
  Gene Name: breakpoint cluster region
  ENST ID: ENST00000427791
  CDS Start-End: 1-771
gccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctgaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtg

SEQ ID NO: 112003 - DNA, 3668 bp, Homo sapiens
  Payload ID: 1950
  Gene Symbol: BRCA1
  Gene Name: breast cancer 1, early onset
  Uniprot ID: P38398
  ENST ID: ENST00000352993
  CDS Start-End: 120-2285
gagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcca

SEQ ID NO: 112004 - DNA, 4497 bp, Homo sapiens
  Payload ID: 1950
  Gene Symbol: BRCA1
  Gene Name: breast cancer 1, early onset
  ENST ID: ENST00000354071
  CDS Start-End: 65-4264
gggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtattggaaccaggtttttgtgtttgccccagtctatttatagaagtgagctaaatgtttatgcttttggggagcacattttacaaatttccaagtatagttaaaggaactgcttcttaaacttgaaacatgttcctcctaaggtgcttttcatagaaaaaagtccttcacacagctaggacgtcatctttgactgaatgagctttaacatcctaattactggtggacttacttctggtttcattttataaaagcaaatccaggtgtcccaaagcaaggaatttaatcattttgtgtgacatgaaagtaaatccagtcctgccaatgagaagaaaaa

SEQ ID NO: 112005 - DNA, 7094 bp, Homo sapiens
  Payload ID: 1950
  Gene Symbol: BRCA1
  Gene Name: breast cancer 1, early onset
  Uniprot ID: P38398
  ENST ID: ENST00000357654
  CDS Start-End: 120-5711
gagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcca

SEQ ID NO: 112006 - DNA, 1312 bp, Homo sapiens
  Payload ID: 1950
  Gene Symbol: BRCA1
  Gene Name: breast cancer 1, early onset
  ENST ID: ENST00000412061
  CDS Start-End: 1-1312
gtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaa

SEQ ID NO: 112007 - DNA, 3273 bp, Homo sapiens
  Payload ID: 1950
  Gene Symbol: BRCA1
  Gene Name: breast cancer 1, early onset
  Uniprot ID: P38398
  ENST ID: ENST00000468300
  CDS Start-End: 195-2294
cttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaa

SEQ ID NO: 112008 - DNA, 726 bp, Homo sapiens
  Payload ID: 1950
  Gene Symbol: BRCA1
  Gene Name: breast cancer 1, early onset
  ENST ID: ENST00000461574
  CDS Start-End: 1-726
atataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagtattaacttcacagaaaagtagtgaataccctataagccagaatccagaaggcctttctgctgacaagtttgagg

SEQ ID NO: 112009 - DNA, 769 bp, Homo sapiens
  Payload ID: 1950
  Gene Symbol: BRCA1
  Gene Name: breast cancer 1, early onset
  ENST ID: ENST00000476777
  CDS Start-End: 103-769
ctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaagg

SEQ ID NO: 112010 - DNA, 582 bp, Homo sapiens
  Payload ID: 1950
  Gene Symbol: BRCA1
  Gene Name: breast cancer 1, early onset
  Uniprot ID: P38398
  ENST ID: ENST00000461798
  CDS Start-End: 114-305
gagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaac

SEQ ID NO: 112011 - DNA, 800 bp, Homo sapiens
  Payload ID: 1950
  Gene Symbol: BRCA1
  Gene Name: breast cancer 1, early onset
  ENST ID: ENST00000487825
  CDS Start-End: 1-800
gagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaag

SEQ ID NO: 112012 - DNA, 5693 bp, Homo sapiens
  Payload ID: 1950
  Gene Symbol: BRCA1
  Gene Name: breast cancer 1, early onset
  Uniprot ID: P38398
  ENST ID: ENST00000461221
  CDS Start-End: 127-318
cctctgctctgggtaaaggtagtagagtcccgggaaagggacagggggcccaagtgatgctctggggtactggcgtgggagagtggatttccgaagctgacagatggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactga

SEQ ID NO: 112013 - DNA, 5732 bp, Homo sapiens
  Payload ID: 1950
  Gene Symbol: BRCA1
  Gene Name: breast cancer 1, early onset
  Uniprot ID: P38398
  ENST ID: ENST00000493795
  CDS Start-End: 233-5683
acagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagctta

SEQ ID NO: 112014 - DNA, 1948 bp, Homo sapiens
  Payload ID: 1950
  Gene Symbol: BRCA1
  Gene Name: breast cancer 1, early onset
  ENST ID: ENST00000493919
  CDS Start-End: 233-1948
acagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtct

SEQ ID NO: 112015 - DNA, 5936 bp, Homo sapiens
  Payload ID: 1950
  Gene Symbol: BRCA1
  Gene Name: breast cancer 1, early onset
  Uniprot ID: P38398
  ENST ID: ENST00000471181
  CDS Start-End: 233-5887
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagattcgcatatacatggccaaaggaacaactccatgttttctaaaaggcctagagaacatatatcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagctta

SEQ ID NO: 112016 - DNA, 779 bp, Homo sapiens
  Payload ID: 1950
  Gene Symbol: BRCA1
  Gene Name: breast cancer 1, early onset
  ENST ID: ENST00000497488
  CDS Start-End: 249-779
ggaggccttcaccctctgctctgggtaaagctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaac

SEQ ID NO: 112017 - DNA, 1612 bp, Homo sapiens
  Payload ID: 1950
  Gene Symbol: BRCA1
  Gene Name: breast cancer 1, early onset
  ENST ID: ENST00000494123
  CDS Start-End: 194-1612
ttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaac

SEQ ID NO: 112018 - DNA, 2108 bp, Homo sapiens
  Payload ID: 1950
  Gene Symbol: BRCA1
  Gene Name: breast cancer 1, early onset
  ENST ID: ENST00000470026
  CDS Start-End: 162-2108
agataactgggcccctgcgctcaggaggccttcaccctctgctctgggtaaaggtagtagagtcccgggaaagggacagggggcccaagtgatgctctggggtactggcgtgggagagtggatttccgaagctgacagatggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagag

SEQ ID NO: 112019 - DNA, 1495 bp, Homo sapiens
  Payload ID: 1950
  Gene Symbol: BRCA1
  Gene Name: breast cancer 1, early onset
  ENST ID: ENST00000484087
  CDS Start-End: 1-1495
gagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaa

SEQ ID NO: 112020 - DNA, 1980 bp, Homo sapiens
  Payload ID: 1950
  Gene Symbol: BRCA1
  Gene Name: breast cancer 1, early onset
  ENST ID: ENST00000477152
  CDS Start-End: 114-1980
gctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaagagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaag

SEQ ID NO: 112021 - DNA, 958 bp, Homo sapiens
  Payload ID: 1950
  Gene Symbol: BRCA1
  Gene Name: breast cancer 1, early onset
  ENST ID: ENST00000473961
  CDS Start-End: 1-958
ttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagag

SEQ ID NO: 112022 - DNA, 1584 bp, Homo sapiens
  Payload ID: 1950
  Gene Symbol: BRCA1
  Gene Name: breast cancer 1, early onset
  ENST ID: ENST00000492859
  CDS Start-End: 50-229
ggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaggtcttactctgttgtcccagctggagtacagtggtgcgatcatgaggcttactgttgccttgacctcctaggctcaagcgatcctatcacctcagtctcccaagtagctgggactattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaac

SEQ ID NO: 112023 - DNA, 1972 bp, Homo sapiens
  Payload ID: 1950
  Gene Symbol: BRCA1
  Gene Name: breast cancer 1, early onset
  ENST ID: ENST00000478531
  CDS Start-End: 103-1972
gacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaa

SEQ ID NO: 112024 - DNA, 2379 bp, Homo sapiens
  Payload ID: 1950
  Gene Symbol: BRCA1
  Gene Name: breast cancer 1, early onset
  Uniprot ID: P38398
  ENST ID: ENST00000491747
  CDS Start-End: 100-2379
ttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactga

SEQ ID NO: 112025 - DNA, 455 bp, Homo sapiens
  Payload ID: 1950
  Gene Symbol: BRCA1
  Gene Name: breast cancer 1, early onset
  ENST ID: ENST00000489037
  CDS Start-End: 160-455
ataactgggcccctgcgctcaggaggccttcaccctctgctctgggtaaaggtagtagagtcccgggaaagggacagggggcccaagtgatgctctggggtactggcgtgggagagtggatttccgaagctgacagatggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaagagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcat

SEQ ID NO: 112026 - DNA, 563 bp, Homo sapiens
  Payload ID: 1950
  Gene Symbol: BRCA1
  Gene Name: breast cancer 1, early onset
  ENST ID: ENST00000591849
  CDS Start-End: 158-448
tttctcagataactgggcccctgcgctcaggaggccttcaccctctgctctgggtaaagcaaaagctacccacctttgcctcctgtgcctgcttctgcccagggacttaggtcctcttacaccttagagaaaggccttagcatctggtcacaggcagatgagtgacagcaagaaaacctggctgcaatatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctact

SEQ ID NO: 112027 - DNA, 781 bp, Homo sapiens
  Payload ID: 1950
  Gene Symbol: BRCA1
  Gene Name: breast cancer 1, early onset
  ENST ID: ENST00000586385
  CDS Start-End: 145-666
tttctcagataactgggcccctgcgctcaggaggccttcaccctctgctctgggtaaaggtagtagagtcccgggaaagggacagggggcccaagtgatgctctggggtactggcgtgggagagtggatttccgaagctgacagatggatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctact

SEQ ID NO: 112028 - DNA, 1282 bp, Homo sapiens
  Payload ID: 1950
  Gene Symbol: BRCA1
  Gene Name: breast cancer 1, early onset
  ENST ID: ENST00000591534
  CDS Start-End: 103-1167
tttctcagataactgggcccctgcgctcaggaggccttcaccctctgctctgggtaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctact

SEQ ID NO: 112029 - DNA, 718 bp, Homo sapiens
  Payload ID: 1950
  Gene Symbol: BRCA1
  Gene Name: breast cancer 1, early onset
  ENST ID: ENST00000618469
  CDS Start-End: 648-718
gctgagacttcctggacgggggacaggctgtggggtttctcagataactgggcccctgcgctcaggaggccttcaccctctgctctgggtaaaggtagtagagtcccgggaaagggacagggggcccaagtgatgctctggggtactggcgtgggagagtggatttccgaagctgacagatgggtattctttgacggggggtaggggcggaacctgagaggcgtaaggcgttgtgaaccctggggaggggggcagtttgtaggtcgcgagggaagcgctgaggatcaggaagggggcactgagtgtccgtgggggaatcctcgtgataggaactggaatatgccttgagggggacactatgtctttaaaaacgtcggctggtcatgaggtcaggagttccagaccagcctgaccaacgtggtgaaactccgtctctactaaaaatacaaaaattagccgggcgtggtgccgctccagctactcaggaggctgaggcaggagaatcgctagaacccgggaggcggaggttgcagtgagccgagatcgcgccattgcactccagcctgggcgacagagcgagactgtctcaaaacaaaacaaaacaaaacaaaacaaaaaacaccggctgttcattggaacagaaagaaatggatttatctgctcttcgcgttgaagaagtacaaaatgtcattaatgctatgcagaaaatcttagagtg

SEQ ID NO: 112030 - DNA, 2534 bp, Homo sapiens
  Payload ID: 1950
  Gene Symbol: BRCA1
  Gene Name: breast cancer 1, early onset
  ENST ID: ENST00000634433
  CDS Start-End: 140-2534
aaagcgtgggaattacagataaattaaaactgtggaacccctttcctcggctgccgccaaggtgttcggtccttccgaggaagctaaggccgcgttggggtgagaccctcacttcatccgttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccaca

SEQ ID NO: 112031 - DNA, 11986 bp, Homo sapiens
  Payload ID: 1951
  Gene Symbol: BRCA2
  Gene Name: breast cancer 2, early onset
  Uniprot ID: P51587
  ENST ID: ENST00000380152
  CDS Start-End: 234-10490
gggcttgtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcggacttatttaccaagcattggaggaatatcgtaggtaaaaatgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagtagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaggggaaaagaaaatcttttaaatctttggatttgatcactacaagtattattttacaagtgaaataaacataccattttcttttagattgtgtcattaaatggaatgaggtctcttagtacagttattttgatgcagataattccttttagtttagctactattttaggggattttttttagaggtaactcactatgaaatagttctccttaatgcaaatatgttggttctgctatagttccatcctgttcaaaagtcaggatgaatatgaagagtggtgtttccttttgagcaattcttcatccttaagtcagcatgattataagaaaaatagaaccctcagtgtaactctaattcctttttactattccagtgtgatctctgaaattaaattacttcaactaaaaattcaaatactttaaatcagaagatttcatagttaatttattttttttttcaacaaaatggtcatccaaactcaaacttgagaaaatatcttgctttcaaattggcactgattctgcctgctttatttttagcgctatcacaggacccagagcctatgcccttttaaacttaccacaaaagcagaagattaattcaatttaagatgatactctcatttgttacgtcctttttttttttttttggagatggagtcttgctttgtcgcccatgctggagtgcagtggcatgatcctggctcactgcagcctccacttcccgggttcacgtaattctcccacctcaagcctccctagtagctgggattacagggacgcaccaccatgcccagctaatttttgcatttttagtagagactgggttttaccatgttggccaagctggtctcaaactcctgatgtcaggtgatccatctgcctcagcctcccaaagtgctgggattataggcgtgagccactgtgcccggccaatatttgttactttcttaggtttaatagagaaaagggataaaacatttctaactgggagttaattgcatggagaaggtcttaaatcagatgttttaatgccttaaatgtctgtataatatcatgttttcaaatctaattataaatacgtttaaagccaagaataaatcttttaaaaaatt

SEQ ID NO: 112032 - DNA, 495 bp, Homo sapiens
  Payload ID: 1951
  Gene Symbol: BRCA2
  Gene Name: breast cancer 2, early onset
  ENST ID: ENST00000528762
  CDS Start-End: 1-195
tcatctggattatacatatttcgcaatgaaagagaggaagaaaaggaagcagcaaaatatgtggaggcccaacaaaagagactagaagccttattcactaaaattcaggaggaatttgaagaacatgaagttacttcctccactgaagtcttgaaccccccaaagtcatccatgagggttggaatcaacttctgaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattc

SEQ ID NO: 112033 - DNA, 842 bp, Homo sapiens
  Payload ID: 1951
  Gene Symbol: BRCA2
  Gene Name: breast cancer 2, early onset
  ENST ID: ENST00000470094
  CDS Start-End: 1-560
aatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagagacagagtcttgctttgtcacccccaggctggagtacaatagcacaatctcggatcactgcagtgtctgcctcctgggctcaagcgattctcgtgccttagcctcccaagtagctgggactacagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgt

SEQ ID NO: 112034 - DNA, 10984 bp, Homo sapiens
  Payload ID: 1951
  Gene Symbol: BRCA2
  Gene Name: breast cancer 2, early onset
  Uniprot ID: P51587
  ENST ID: ENST00000544455
  CDS Start-End: 228-10484
gtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcggacttatttaccaagcattggaggaatatcgtaggtaaaaatgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagtagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaggggaaaagaaaatcttttaaatctttggatttgatcactacaagtattattttacaatcaacaaaatggtcatccaaactcaaacttgagaaaatatcttgctttcaaattggcact

SEQ ID NO: 112035 - DNA, 3221 bp, Homo sapiens
  Payload ID: 1952
  Gene Symbol: BCAR1
  Gene Name: breast cancer anti-estrogen resistance 1
  Uniprot ID: P56945
  ENST ID: ENST00000162330
  CDS Start-End: 128-2740
ggccgaggcggcagctgcgcggcggcaccggggcggctgcggcgcgctcggagccccgagggcacgcggcccgggcagctcggtgtgcgcccccgcgagagccggggccccaggcccgccggacaccatgaaccacctgaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagca

SEQ ID NO: 112036 - DNA, 2667 bp, Homo sapiens
  Payload ID: 1952
  Gene Symbol: BCAR1
  Gene Name: breast cancer anti-estrogen resistance 1
  Uniprot ID: P56945
  ENST ID: ENST00000393420
  CDS Start-End: 1-2667
atgaaccacctgaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtgagcaaatgccagggcaatgccagggccaggctgaggctgtggggtgtctgggtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctga

SEQ ID NO: 112037 - DNA, 4064 bp, Homo sapiens
  Payload ID: 1952
  Gene Symbol: BCAR1
  Gene Name: breast cancer anti-estrogen resistance 1
  Uniprot ID: P56945
  ENST ID: ENST00000393422
  CDS Start-End: 74-2740
tttgcctgccaggagtgggtgagggaggagcagccgccgccttcacagacacctggtagtgtcaggagagggcatgcactgccctggtgaggctcctctggctgcccccaggcccacacccaaggatccctgcctcagaaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagcagctgcctgagggtggcagatgagagcagcccggggtgggtgacggttctggggaaggcacccgggggcaagggccatgcgtggcatctcccgggagggcagaggaggagtgggtctctctagaagaaaaccaaggaacgccgaggctgggtgtctcctggaggcggggtgaggcctgcagctggccacaaggccctgggagccagggcagagcctgggcccaagaaagggggcagtttcagagctgcagggtctggggcccagaaagcacagcctgggcatggcccctgcaaccctagggagctgccacagtgagcacctgcccatgcccacagctggcatctggagtgagggcagattggggcaggaacagctgcacaaggggacgggttcctgtgagccgagggcaccgctgggggctgcatccagagctctgcttaaaagaatctcatcccagcctgcggaactcccgaagtgcacatggaattatacctggacctggcatctgagttgggagggaggggcttggagaagacccttgccctgggcaagtgtgtcccccttcgtggctcccccacccagcagcccgcagcccagatggaagcttcagggtgcttggaacccctggtgctgctcccagccctgaccgttctgcatatgaacatgggccttggtttccccatctgtatgaagaagggagtagggctgggtgattcgcaagccctcctgatcttacctctacagaggttgtccccgtgacagcatctgtccccccacctcagccacatcatgctcagcccacctgccttggtgaggacacagaggtaaaggtgtatgcagttgc

SEQ ID NO: 112038 - DNA, 3387 bp, Homo sapiens
  Payload ID: 1952
  Gene Symbol: BCAR1
  Gene Name: breast cancer anti-estrogen resistance 1
  Uniprot ID: P56945
  ENST ID: ENST00000418647
  CDS Start-End: 285-3035
atgcgcggcgcggctggagcggccggacagtccggcgtccgggaacgctcaggagccggaggagccggaaagcgccgggacccctcgcggggcctctgagcggcgcgggcggacccgagcccccagcccgctggcgccgctgcccgccaggccccgggggcggcggccaagatgtccgtgcctatgaaaaaatgagggcttccagactgtgctgatgtgagccccgccatccgttctggttcagagcataatcgtctcgtcttcagaaagaaggaagacagaacatgcctgccaagcccttcctctcttctgttctgctctcctggaaagttctggacttctctggcccagggcctcaggggactggccagccctgctcctgtgggcactgggcagagggacaaggcggaccacctgagcctgctggagggccgaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgaca

SEQ ID NO: 112039 - DNA, 2725 bp, Homo sapiens
  Payload ID: 1952
  Gene Symbol: BCAR1
  Gene Name: breast cancer anti-estrogen resistance 1
  Uniprot ID: P56945
  ENST ID: ENST00000420641
  CDS Start-End: 3-2669
agatgctcacccaccgtccccaggaagcagaacagaggggtcggacccctggtccttcctttgagtggaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctgg

SEQ ID NO: 112040 - DNA, 2894 bp, Homo sapiens
  Payload ID: 1952
  Gene Symbol: BCAR1
  Gene Name: breast cancer anti-estrogen resistance 1
  Uniprot ID: P56945
  ENST ID: ENST00000535626
  CDS Start-End: 277-2445
aggagccggaaagcgccgggacccctcgcggggcctctgagcggcgcgggcggacccgagcccccagcccgctggcgccgctgcccgccaggccccgggggcggcggccaagatgtccgtgccttgccgctctcctaccccatgtcgctgaagcagatgagttggagcaggactcaggagggtactaggcccaggttttaggctgaacctaggaatgagtaatgagaggaggcagatcagctggaggaccagcccgagtccccagatgtcggcacaatgcaggggaagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtct

SEQ ID NO: 112041 - DNA, 2846 bp, Homo sapiens
  Payload ID: 1952
  Gene Symbol: BCAR1
  Gene Name: breast cancer anti-estrogen resistance 1
  Uniprot ID: P56945
  ENST ID: ENST00000542031
  CDS Start-End: 182-2788
aaaggcctgtgacatttcctctggtggtttccacgaacccaggcgtcacccctcggtggagataaagtggagccacccagctccaccgtgtctcagcctggggtcggcctctgctgcttctggactcagtgaccctgggctgtcagggagcttctgagccttggttttcctgtctagtaagatggagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggct

SEQ ID NO: 112042 - DNA, 1340 bp, Homo sapiens
  Payload ID: 1952
  Gene Symbol: BCAR1
  Gene Name: breast cancer anti-estrogen resistance 1
  ENST ID: ENST00000546196
  CDS Start-End: 716-889
actttcctgggaagttttcctctcgctgcggaacccccggggccctgactggccgcttcctccccgctggccgtagggagttttctgtccgacaccccctcttcctggccgggcagcctggcttcggcagacccccgggccatgtttccacacttgggcactggcatctctgagcatctcagtctcacctcctgagaacagcaagtgatcctggctaccccgggtaaccaggcctcaggtgcaggccccacatgacagatggacagactgaagtgggaggtgggaggcggacaccccggcgtcctgccaggaagggacaccatctgcacctggcgagctgtggcctccagccatcgtttccctgcctagttaggggcttttccctccagagccctgtccactctggccttgtttctggaactgctcctcacccggaggaccccatcctttccgtgaagcaggcagtgggggctttctggcaagtggcctcttcattaactatcccagagtgagtgcagatgaccagagggaagctggccaagtgcaaagcattgttattgtggaattaaagagcccgctcctgctcgcctccagaagtggtaatgtatttacagatgaaaaaatgagggcttccagactgtgctgatgtgagccccgccatccgttctggttcagagcataatcgtctcgtcttcagaaagaaggaagacagaacatgcctgccaagcccttcctctcttctgttctgctctcctggaaagttctggacttctctggcccagggcctcaggggactggccagccctgctcctgtgggcactgggcagagggacaaggcggaccacctgagcctgctggagggccggtatcccagggcagtagtgattagggaatgtcactctggccacatcccagcctgggcgggcctctatggggaggtccccgtttgatttggtttggttgtccacagtcagagccaagctctgggcatggagtctgggatggcaccctgaccccttgccttacaggactttgggcagccttctttggcactgtgcctcatctgtaacaagagaggaacagcgggctgggtaggacttggacagataggcactgtcgtggggacctgcagcctggccacaccatcacgggctctgagtcatctcctaccctctcccttgtagtcacagcccaggagaattctgctgggggtgggcagaggtctttgccatctgccccctacgtggctggctggcagatcaccgtggctctctctcctgggaccttgggcagtgtgtgaggtggtggggccaagaggagaattcatttttggaacagtc

SEQ ID NO: 112043 - DNA, 3192 bp, Homo sapiens
  Payload ID: 1952
  Gene Symbol: BCAR1
  Gene Name: breast cancer anti-estrogen resistance 1
  Uniprot ID: P56945
  ENST ID: ENST00000538440
  CDS Start-End: 172-2784
atgcgcggcgcggctggagcggccggacagtccggcgtccgggaacgctcaggagccggaggagccggaaagcgccgggacccctcgcggggcctctgagcggcgcgggcggacccgagcccccagcccgctggcgccgctgcccgccaggccccgggggcggcggccaagatgtccgtgcctaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaact

SEQ ID NO: 112044 - DNA, 714 bp, Homo sapiens
  Payload ID: 1952
  Gene Symbol: BCAR1
  Gene Name: breast cancer anti-estrogen resistance 1
  ENST ID: ENST00000569340
  CDS Start-End: 1-714
gccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatg

SEQ ID NO: 112045 - DNA, 4659 bp, Homo sapiens
  Payload ID: 1952
  Gene Symbol: BCAR1
  Gene Name: breast cancer anti-estrogen resistance 1
  ENST ID: ENST00000562556
  CDS Start-End: 716-889
actttcctgggaagttttcctctcgctgcggaacccccggggccctgactggccgcttcctccccgctggccgtagggagttttctgtccgacaccccctcttcctggccgggcagcctggcttcggcagacccccgggccatgtttccacacttgggcactggcatctctgagcatctcagtctcacctcctgagaacagcaagtgatcctggctaccccgggtaaccaggcctcaggtgcaggccccacatgacagatggacagactgaagtgggaggtgggaggcggacaccccggcgtcctgccaggaagggacaccatctgcacctggcgagctgtggcctccagccatcgtttccctgcctagttaggggcttttccctccagagccctgtccactctggccttgtttctggaactgctcctcacccggaggaccccatcctttccgtgaagcaggcagtgggggctttctggcaagtggcctcttcattaactatcccagagtgagtgcagatgaccagagggaagctggccaagtgcaaagcattgttattgtggaattaaagagcccgctcctgctcgcctccagaagtggtaatgtatttacagatgaaaaaatgagggcttccagactgtgctgatgtgagccccgccatccgttctggttcagagcataatcgtctcgtcttcagaaagaaggaagacagaacatgcctgccaagcccttcctctcttctgttctgctctcctggaaagttctggacttctctggcccagggcctcaggggactggccagccctgctcctgtgggcactgggcagagggacaaggcggaccacctgagcctgctggagggccggtatcccagggcagtagtgattagggaatgtcactctggccacatcccagcctgggcgggcctctatggggaggtccccgtttgatttggtttggttgtccacagtcagagccaagctctgggcatggagtctgggatggcaccctgaccccttgccttacaggactttgggcagccttctttggcactgtgcctcatctgtaacaagagaggaacagcgggctgggtaggacttggacagataggcactgtcgtggggacctgcagcctggccacaccatcacgggctctgagtcatctcctaccctctcccttgtagtcacagcccaggagaattctgctgggggtgggcagaggtctttgccatctgccccctacgtggctggctggcagatcaccgtggctctctctcctgggaccttgggcagtgtgtgaggtggtggggccaagaggagaattcatttttggaacagtcttgaagtgttcggaaaattgctttcatgtgctgaggaggccctgcggaggcttccagactgagctgcctgctcaagccctgcccttggaacccagagtggcgactgctcagggacacgtctgggttttaagcacacccatccatttgggcagtcttttcctagatgggctgacgcagcaggcactttggcccacagaaattataagatgcttcagaaggggatgggaggggaagcaggaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagc

SEQ ID NO: 112046 - DNA, 558 bp, Homo sapiens
  Payload ID: 1952
  Gene Symbol: BCAR1
  Gene Name: breast cancer anti-estrogen resistance 1
  ENST ID: ENST00000564028
  CDS Start-End: 158-558
gtgcatttgttggagagcggtgtcctgcgccctaggctggaagcctggcctcgggcaggggcctggagcctcggggttggagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacaga

SEQ ID NO: 112047 - DNA, 556 bp, Homo sapiens
  Payload ID: 1952
  Gene Symbol: BCAR1
  Gene Name: breast cancer anti-estrogen resistance 1
  ENST ID: ENST00000568864
  CDS Start-End: 152-556
cagccctgctcctgtgggcactgggcagagggacaaggcggaccacctgagcctgctggagggccggtatcccaggaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctg

SEQ ID NO: 112048 - DNA, 547 bp, Homo sapiens
  Payload ID: 1952
  Gene Symbol: BCAR1
  Gene Name: breast cancer anti-estrogen resistance 1
  ENST ID: ENST00000566465
  CDS Start-End: 164-547
ataaaggcatctgctgtggtgctgcagccaaggccaggctgtgctctgtgcttgtgtcggggagcccttggcagtggccaccccacagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgttt

SEQ ID NO: 112049 - DNA, 558 bp, Homo sapiens
  Payload ID: 1952
  Gene Symbol: BCAR1
  Gene Name: breast cancer anti-estrogen resistance 1
  ENST ID: ENST00000563323
  CDS Start-End: 383-558
tccggggtggggagctcctcttccctgggggtctcggggctcgctctcagctgggggagggcagaggggctccgggaggcctgctatgctgccccgcgatcaccttccgccggccgagccctcccggtctgcgcccggacacagggcctaggagcccggccagggccacagggcagtgtagtgttgggggaggggactggttgggcgacccagagctggtgcgactggaggtggcccgcgagggatcggcgaggagcggaggagaccgcgcctccccgccgcgttgggccgacagaaaaaggcctagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctgg

SEQ ID NO: 112050 - DNA, 581 bp, Homo sapiens
  Payload ID: 1952
  Gene Symbol: BCAR1
  Gene Name: breast cancer anti-estrogen resistance 1
  ENST ID: ENST00000567215
  CDS Start-End: 431-581
gcagatggggacactgaggtacagagagacagtcagttgtcctcagaattggatccagaacctcgtcttctggcatggccccccagtgcagcaccacatgtggcctccgaattcccagtctgggattgggggagctctggtccttgggggaccaccatgctcttttggagttgtcaacttggtaggaaccctctggttccaacgctgtgcctttgcggccctctcctggcatctgctgtccctttaggaggtcctaccacccttttcttctgagcctggacaactccttcccttgcccccaggagcccacagccggctaaaccaactggtcagctagaaccaaccagcaggggagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccg

SEQ ID NO: 112051 - DNA, 594 bp, Homo sapiens
  Payload ID: 1952
  Gene Symbol: BCAR1
  Gene Name: breast cancer anti-estrogen resistance 1
  ENST ID: ENST00000561970
  CDS Start-End: 355-594
aatgattcactccggccgccggcgcggggttccgggagcggagcgggagtgggggcgggcgcgccgcgggctttgcagccccgcacgccgagcgccggtggaagccgggtcctggccacaggagtcctagccgcacgcgagtgtcgcgggagggggccagggccgggttctgcagtgtggacatgaaggctttggagtccatggttgggggacccgcaagagctagagcagggtcggagctccctctcgagggtccgagaggctgatcgctggaccgagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccc

SEQ ID NO: 112052 - DNA, 574 bp, Homo sapiens
  Payload ID: 1952
  Gene Symbol: BCAR1
  Gene Name: breast cancer anti-estrogen resistance 1
  ENST ID: ENST00000569006
  CDS Start-End: 215-574
agtcctgagtgcatgctctgcggtctggggtcacctggggtgcttaccagtaggcacacgcctgggttatgaggtggaaggtgcgagctctgctggccatgggagctgcgtggggcattgcccctctctctgcctccagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcg

SEQ ID NO: 112053 - DNA, 3171 bp, Homo sapiens
  Payload ID: 1953
  Gene Symbol: BCAR3
  Gene Name: breast cancer anti-estrogen resistance 3
  Uniprot ID: O75815
  ENST ID: ENST00000260502
  CDS Start-End: 244-2721
gcctgctgctggccgggcgggggacggggccgggaccggagccggagctgcggggcgcaccggctagacgcgcgcgggattctcggcgggcacgccccgcggaccatgagcgtccccagctccgggagcagccgcggcgcgggcggtgcgaggccggccgcgcggcgcctttgagccccagccggaggtccagagatcctgagagcccgagcgcccagcgccgcgccgggagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtgaaa

SEQ ID NO: 112054 - DNA, 3200 bp, Homo sapiens
  Payload ID: 1953
  Gene Symbol: BCAR3
  Gene Name: breast cancer anti-estrogen resistance 3
  Uniprot ID: O75815
  ENST ID: ENST00000370243
  CDS Start-End: 276-2753
gagcgcgctgggactccccgagacgtggcccacggcggggagcgctcagcgattggcggccaggcatcttgctcggtggcactcgagcggcatcttcccgggcgctggcctcgcccgaccccctgcccgtcggagctgctctgccggccaccccgccctgtcccgcccgtcccctcttcgcagaagccggccggggtcgggcagatgcgagggcccagagcgctctggtggaagcccaaggctccgaggaggcgagtttctccgagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtg

SEQ ID NO: 112055 - DNA, 3217 bp, Homo sapiens
  Payload ID: 1953
  Gene Symbol: BCAR3
  Gene Name: breast cancer anti-estrogen resistance 3
  Uniprot ID: O75815
  ENST ID: ENST00000370244
  CDS Start-End: 290-2767
aagccgggccggtgacgccgggcctttacgtcgcgcctgtgagcggccgaggccgagcggcctcccctcgggctgcgagacggagacattacctcatccctcaagattgctcgctgcaaacacaacgctgagaaatggcccaagtaaagcgtgatcagggtcttgcattcttggcacatctaggaagaacgtgcaaggatgcgaattgtgaatcgcttctccaaacagagctgcttcatctgacccaagctggcctggagaaaggaggaagaggcaagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcagggatccacatcttctggacccaactgtggaatatgtgaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtgaaa

SEQ ID NO: 112056 - DNA, 2827 bp, Homo sapiens
  Payload ID: 1953
  Gene Symbol: BCAR3
  Gene Name: breast cancer anti-estrogen resistance 3
  Uniprot ID: O75815
  ENST ID: ENST00000370247
  CDS Start-End: 168-2372
agactagcctgggagaaggagccgactcactcccccggctgccgacttccctgacttctgggcagaaacagcacagctgctgtggtgggctagggctttaacgtccgaagccccctttcttttaaccctaaagaaagtgtgtggtccccgggactgaagaccgaaagatgcctaaggaatgcagtgctttccacgccctctcagcagctctgtgctgcttctatcaccgcaagtctttcattggagtcaagttctccaaggagaggcacatcatggacaggacccccgagaaactgaagaaggagctggaggaggagctgctcctgagcagcgaggacctgcgcagccatgcctggtaccacggccgcatcccccgacaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtgaaacagtt

SEQ ID NO: 112057 - DNA, 2114 bp, Homo sapiens
  Payload ID: 1953
  Gene Symbol: BCAR3
  Gene Name: breast cancer anti-estrogen resistance 3
  Uniprot ID: O75815
  ENST ID: ENST00000539242
  CDS Start-End: 155-1660
cttttgtaatttgccctcggtcttgtcttatcttcgaaaggttgctggaatttctctgttccttggagtttgggggttttttgatttgttttttctttggtgcttgtaaagaaacaaagaaaagagtggtagccagcccgcctgcctggatcacatgcaggacagaagagccttgtccctcaaagcccaccagtcagagagctacctgccgattggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggttgctaggatacttggagtctctgaagagatgaggaggaacatgggggtgagctcaggcctggaactcattaccttgcctcacggacaccagctgcgcctggacataattgaaagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacagatcacaaggttagaaaagacgtggactgctctgcggcaccagtacacccaaactgccattctctatgagaaacagctgaagcccttcagcaaactcctgcatgaaggcagagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtgaaacagt

SEQ ID NO: 112058 - DNA, 1445 bp, Homo sapiens
  Payload ID: 1954
  Gene Symbol: BRMS1
  Gene Name: breast cancer metastasis suppressor 1
  Uniprot ID: Q9HCU9
  ENST ID: ENST00000359957
  CDS Start-End: 162-902
gatgacgcacacggaagcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggatgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctggga

SEQ ID NO: 112059 - DNA, 1363 bp, Homo sapiens
  Payload ID: 1954
  Gene Symbol: BRMS1
  Gene Name: breast cancer metastasis suppressor 1
  ENST ID: ENST00000425825
  CDS Start-End: 156-1028
gcacacggaagcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggatgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatgacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggactctgg

SEQ ID NO: 112060 - DNA, 1131 bp, Homo sapiens
  Payload ID: 1954
  Gene Symbol: BRMS1
  Gene Name: breast cancer metastasis suppressor 1
  ENST ID: ENST00000524699
  CDS Start-End: 1-802
gacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggatgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctggga

SEQ ID NO: 112061 - DNA, 963 bp, Homo sapiens
  Payload ID: 1954
  Gene Symbol: BRMS1
  Gene Name: breast cancer metastasis suppressor 1
  ENST ID: ENST00000530756
  CDS Start-End: 231-963
agaagggagcgggaggccccctgggcgctgcggagaagctggattgacctctgcgagagtggggagggtctgccttccctaggggcctgccccggaggagctgccattctgaaaagataaattgcctgtgtacagcgctttacagtgtgcttttccatcccttaccacctgtgagctcctcaacactcagagcaggaatggttatccgctttttgcacccgggagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggatgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatg

SEQ ID NO: 112062 - DNA, 913 bp, Homo sapiens
  Payload ID: 1954
  Gene Symbol: BRMS1
  Gene Name: breast cancer metastasis suppressor 1
  ENST ID: ENST00000527375
  CDS Start-End: 116-496
gggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggatgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggaccttgaccctgctgttcacagccagggggaccctcagagcagctggcactgcacccaggattctcgtcttcctcctgcagacaggcggacccacaggcccctcagggtct

SEQ ID NO: 112063 - DNA, 2657 bp, Homo sapiens
  Payload ID: 1955
  Gene Symbol: BRMS1L
  Gene Name: breast cancer metastasis-suppressor 1-like
  Uniprot ID: Q5PSV4
  ENST ID: ENST00000216807
  CDS Start-End: 200-1171
ggaaggcctccgccaatggcagagctcccatcgcagagcctgcgggttaggttgtgaggcccgggccgggggcggggaggagccaagggggcgagcaagctcggtggctgggtgggttggggcgttccgcgcgcccttcattgaagcggcggtggccgggctgggcgccggtagtggaaagcgacggcgcggctggaaaatgccagtccattcccgaggggataagaaggagaccaaccatcacgatgagatggaggtggactacgccgaaaatgaggggagcagctccgaggacgaggacactgagagctcgtcggtctccgaggatggagatagctcagaaatggatgatgaagactgtgaaagaagaagaatggaatgtttggatgaaatgtccaatcttgaaaaacagtttaccgatctcaaagatcaactttataaagaacgattaagtcaggtggatgcaaaactacaagaagtcatagctggaaaagcaccagaatacttggaaccgctggcaactttacaggaaaatatgcaaattcgtacaaaggtagcaggaatctatagagagctctgcttagaatctgtaaagaacaaatatgaatgtgaaattcaagcttctcgccagcattgtgagagcgaaaagctgttgctatatgatacagtccagagtgaactagaggagaagataagaaggcttgaagaggataggcacagcattgatattacctcagagctgtggaatgatgagcttcagtcaagaaaaaagaggaaggatcctttcagtcctgacaaaaagaagccagttgttgtttcaggtccatatatagtttatatgctacaagatcttgatattcttgaagactggacaacaattaggaaggcaatggctacattggggccacacagagtgaaaacggaaccacctgtgaaactggaaaaacatctgcacagtgctagatctgaagagggaagactatattatgatggtgaatggtatatacgtggacaaacaatatgtattgataaaaaagatgaatgtcctacaagtgctgtaattacaacaattaaccatgatgaagtttggtttaagaggcctgatggaagcaaatctaagctttacatttcacagctacagaaaggaaaatattcaattaaacattcataatcatgatttaagtgttatctaaatttaccttattagtgttaccaaatgtaagtgccatgagagtaaaaaaatgtattcaataacttaatattctcactgaatcatgagagaatgtgtatttgtaggtagtactctaaatagatctcattgatatgttattaaaagaaacagtaataaaaattttatcacgatccttacgttgatttgcctcttaggtccgatgaccaataggtattctgtatatggtaggggtttctttctaaacatttttctttggttttaaaaaaagttatgcaaatttgtcttatctttagtaaactatgactacatttatctgcaatttttaaaattttccatatctttgtcattcattgtgtgtttgtaaataaggccgatagaatgtttcctataaatggtttgtactagtacattagtgttaaaccagaactgaaatttaaacatatatatatatgaggatgtatatatggcatcatcagcttatttagaactgatggccataccttacaatcttgttttacccaaaattaagctattggggttgaaagctaaaaggagcacttttgtagaatagcaacttttcttttcctctttcttgattgtatggtggggtggtgacctatttttacaaattatacctaatgagtaaaattagtgtaaagtgataacatgcttctacctgtatttctagtgaccctttagcggcaggtatttatacctggtatttatgatgcagtatataagtggtgaacaataactgacagtattgtgcttgctgtacatgtctggtcttttgaaacagattttagtaagcattttccagaggtaaaactgtgtccttattctaattttattcctagggcaaagtagacagggattatttccttgaatctatttccaaattaatatttttttctttggtatttctacactttaaggccatttggtgcaatttagaaagtgttggcctcccttccgctagccacattcaaaattaacttccaaaacctcaggaacagtacaaagaattgaaaccctcaatatggcagcacagccggctgtagtgtatatttagggtacaccaaatcaggtattcctggtggtcttgtgcactttaatttctgttacaatgagttaagaggatgaggaagaaatctacttattaacacttactgcagaaatgtctgcattattccgtttgttttcttattattttacctctccaaacatcttcctgtgcagatcactacttcatagttgccaaattttaaaacacttaactgctgaaattcagtgtcagcaaagtgatattacgttgttctgtttctaattaaccttagcaaatgtacataatgtcaaaacccaatagtatttgacagtacttatgtatacaatgtttgataagcatttttaataagatttgtatttttaaatttagtatataataaaaagatgtgtttcagtgtga

SEQ ID NO: 112064 - DNA, 1201 bp, Homo sapiens
  Payload ID: 1955
  Gene Symbol: BRMS1L
  Gene Name: breast cancer metastasis-suppressor 1-like
  ENST ID: ENST00000551774
  CDS Start-End: 1-647
aggtggatgcaaaactacaagaagtcatagctggaaaagcaccagaatacttggaaccgctggcaactttacaggaaaatatgcaaattcgtacaaaggtagcaggaatctatagagagctctgcttagaatctgtaaagaacaaatatgaatgtgaaattcaagcttctcgccagcattgtgagagcgaaaagctgttgctatatgatacagtccagagtgaactagaggagaagataagaaggcttgaagaggataggcacagcattgatattacctcagagctgtggaatgatgagcttcagtcaagaaaaaagaggaaggatcctttcagtcctgacaaaaagaagccagttgttgtttcaggtccatatatagtttatatgctacaagatcttgatattcttgaagactggacaacaattaggaaggcaatggctacattggggccacacagagtgaaaacggaaccacctgtgaaactggaaaaacatctgcacagtgctagatctgaagagggaagactatattatgatggtgaatggtatatacgtggacaaacaatatgtattgataaaaaagatgaatgtcctacaaggtcatacaatgctgcatatgtgtaccctattggcgtcattatgaagtaattagtttgcgtgtgtgagttgtggcacaggactcaatgcttggcaagctgatattcatatattttgtcttattttagctcttagaatgagccagatatttgaaatatttgtggcacttttctttttaaaggtcaaaacatttaaaactatgtactttgagtatcatgaatttagttctacagataaagaacaaaactgataattctcgaaagttttattaaagtcaatttatatttaagttatatgtatatctcctaaacattgtgaatctgtcttagtccaggatcttataacttttcgccagaactattgaagtattctttcaattggttcctgctgtggacagactaaatggctgtaggatgactccaattattctacccctggtggtctgccctgtgtaactccctcccctcaaatgtgtgccaagcctgggacttgcttctcacctacagaatatgacaaagatgaggagatttttcagatataattaaggttccaaatcagtttttgagttaattgaaagattatcctgggtgggccttacttgatca

SEQ ID NO: 112065 - DNA, 650 bp, Homo sapiens
  Payload ID: 1955
  Gene Symbol: BRMS1L
  Gene Name: breast cancer metastasis-suppressor 1-like
  ENST ID: ENST00000547420
  CDS Start-End: 72-218
gcgcgcccttcattgaagcggcggtggccgggctgggcgccggtagtggaaagcgacggcgcggctggaaaatgccagtccattcccgaggggataagaaggagaccaaccatcacgatgagatggaggtggactacgccgaaaatgaggggagcagctccgaggacgaggacactgagagctcgtcggtctccgaggatggagatagctcagtttgacttttatttgatgaagatcaagatgcagatcattttgtgcttcagttattttgatgaatgaatatatgtgatatgaacatagaaaatgtggactataggacagacctgaaatggatgatgaagactgtgaaagaagaagaatggaatgtttggatgaaatgtccaatcttgaaaaacagtttaccgatctcaaagatcaactttataaagaacgattaagtcaggtggatgcaaaactacaagaagtcatagctggaaaagcaccagaatacttggaaccgctggcaactttacaggaaaatatgcaaattcgtacaaaggtagcagtctcagtggccaggaatttgggagcaacttagctggatggttctggctcagggaatcccaagaagttgcagtgaagatatcagccagggatgcagtcatctcaag

SEQ ID NO: 112066 - DNA, 1544 bp, Homo sapiens
  Payload ID: 1955
  Gene Symbol: BRMS1L
  Gene Name: breast cancer metastasis-suppressor 1-like
  ENST ID: ENST00000552677
  CDS Start-End: 77-223
gttccgcgcgcccttcattgaagcggcggtggccgggctgggcgccggtagtggaaagcgacggcgcggctggaaaatgccagtccattcccgaggggataagaaggagaccaaccatcacgatgagatggaggtggactacgccgaaaatgaggggagcagctccgaggacgaggacactgagagctcgtcggtctccgaggatggagatagctcagtttgacttttatttgatgaagatcaagatgcagatcattttgtgcttcagttattttgatgaatgaatatatgtgatatgaacatagaaaatgtggactataggacagacctgaaatggatgatgaagactgtgaaagaagaagaatggaatgtttggatgaaatgtccaatcttgaaaaacagtttaccgatctcaaagatcaactttataaagaacgattaagtcaggtggatgcaaaactacaagaagtcatagctggaaaagcaccagaatacttggaaccgctggcaactttacaggaaaatatgcaaattcgtacaaaggtagcaggaatctatagagagctctgcttagaatctgtaaagaacaaatatgaatgtgaaattcaagcttctcgccagcattgtgagagcgaaaagctgttgctatatgatacagtccagagtgaactagaggagaagataagaaggcttgaagaggataggcacagcattgatattacctcagagctgtggaatgatgagcttcagtcaagaaaaaagaggaaggatcctttcagtcctgacaaaaagaagccagttgttgtttcaggtccatatatagtttatatgctacaagatcttgatattcttgaagactggacaacaattaggaaggcaatggctacattggggccacacagagtgaaaacggaaccacctgtgaaactggaaaaacatctgcacagtgctagatctgaagagggaagactatattatgatggtgaatggtatatacgtggacaaacaatatgtattgataaaaaagatgaatgtcctacaagtgctgtaattacaacaattaaccatgatgaagtttggtttaagaggcctgatggaagcaaatctaagctttacatttcacagctacagaaaggaaaatattcaattaaacattcataatcatgatttaagtgttatctaaatttaccttattagtgttaccaaatgtaagtgccatgagagtaaaaaaatgtattcaataacttaatattctcactgaatcatgagagaatgtgtatttgtaggtagtactctaaatagatctcattgatatgttattaaaagaaacagtaataaaaattttatcacgatccttacgttgatttgcctcttaggtccgatgaccaataggtattctgtatatggtaggggtttctttctaaacatttttctttggttttaaaaaaagttatgcaaatttgtcttatctttagtaaactatgactacatttatctgcaatttttaaaattttccatatctttgtcattcattgtgtgtttgt

SEQ ID NO: 112067 - DNA, 3020 bp, Homo sapiens
  Payload ID: 1956
  Gene Symbol: BCAS1
  Gene Name: breast carcinoma amplified sequence 1
  ENST ID: ENST00000371435
  CDS Start-End: 119-1639
gctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaaaggcagtggcaagtaagttatagaagagaaatgctgctagaaggaattaagcgttgtagtaaatgcgtgcttatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaaaaataaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaa

SEQ ID NO: 112068 - DNA, 2581 bp, Homo sapiens
  Payload ID: 1956
  Gene Symbol: BCAS1
  Gene Name: breast carcinoma amplified sequence 1
  ENST ID: ENST00000371440
  CDS Start-End: 483-1637
gctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaaaggcagtggcaagtaagttatagaagagaaatgctgctagaaggaattaagcgttgtagtaaatgcgtgcttatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaactt

SEQ ID NO: 112069 - DNA, 3303 bp, Homo sapiens
  Payload ID: 1956
  Gene Symbol: BCAS1
  Gene Name: breast carcinoma amplified sequence 1
  Uniprot ID: O75363
  ENST ID: ENST00000395961
  CDS Start-End: 168-1922
gtattcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaaaggcagtggcaagtaagttatagaagagaaatgctgctagaaggaattaagcgttgtagtaaatgcgtgcttatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaaaaataaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaa

SEQ ID NO: 112070 - DNA, 6112 bp, Homo sapiens
  Payload ID: 1956
  Gene Symbol: BCAS1
  Gene Name: breast carcinoma amplified sequence 1
  ENST ID: ENST00000448484
  CDS Start-End: 1-1431
acacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacggcatcgaaagcagaaagtgtctgtgatggacaagctggtcagaagacatccgagatccaggctagaggcaccaagaaaaagcacctggatagccccaggctaggactcgcctttagaaaattctttaggcataagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaaggtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtacacagggaagtgtgtcttctcccatgtcaagaagaagtggcctttccaggaatggagctattgagctgaaatggctgccactgcgcgtacacacacacacgcgcacacacacacacacacacacacctcccttccagttccagctgacggtgactttttgactggtaaccataaaagaattcattcaaaagggcagttgttcccagcagccagtgaggtccttcctgcattcgttgtcttggagaaggaggcacataacaaaatagaaaccaaaatgggaaggaaaagagaaagaaagtgaaattcctggtctttgttgtatgtatccccttgctttttagataaattatcaggggtttaaacacacactctctcccctccctcctcccacttcacacacactagattgttcttgtctgtttgcaaacagtccagaagcactggggtctcattaaattagattctaagtgtcttaaagaattagatttcaagaaaccaagaatctgtgtcctttcccttctcagagtgcctggaagggtgcagatttctccaatctgaatctgacaatgttatttcttatgtcagataatcccaagtagatcttataccttaaaaaaataaaatcagctacactacctaccttacagggaaggaaaaagaactaattccaattattaactaacccaagatacaaacacaggggaaactagggaatgtgctttgcagcaatgtaagattataggggttggttttaaccatcctttgaatgtccctctttaagcctttttaaagggcaattttgcacggtgagtagaattaggcttctccgtggtcaagattttgttcactctatcagtgcaaattaagtggcaccggcccactggaaattatagtctccattaggaagaaaagaaattacttaccgagcagcaaattctctaaatttgtaattcagatctttagtgcagaatgccggtcaggatccagccctttgcataaattggttttctggggagtttaaccccttagcctctgttgcccttttcttgaatggcattcacgcaaccctctccatctcctggccctttaactggccccggcagaagttgcagtccacaatttcacagaagtaaggataatacattatcacacattaccgtttataaagtgctctgggtacaatctgtaatttaaagctgtatttccctcactgaacttaagtgcttcctttgttacatttcattaccgggggactggcatgcacctgtatagattttttttttttttttcattttttgttttgttttgtttttccaaataagcacttcttgacaaaatggcccccagctgcacttctgctaatgacagccatggaagggctggttccttacgtgatctactctctcagaagcttgcttttgtcaaaatgcagccacgtgggggagctgcaggacctggggttttacaatgcctagccctttttccctgattgcctaaccgggaaactgggccaaagcagcctgagagtgtatttgttgattaacttctagaaagcagtcaagtttaattaggagaactagaacgagaaagctgaactgggcaagtcagttgccttctatgattctcagtcctccaaatgaagataaggttggttggtttgtgtttccatccttatctgctctatcttggaagaagctcaaggaagattgtgtgattgcaaaacgtttcagttggtgtcattgcaatgcatttaagtaatccttactggcccatcctgctccacaaagcagccttacctctcatcttctccactcccaactaaagagcaagtgatttaaactctgagtgtcctccctcaacaatgggctaataatagagcctactcgtggagttgctgccagcatgcagtgagatggtgcataccaaacatttagtgcagtggctggcacattgtaagcacttaggaaaggcaagctattctatcatggggaacttttagcaccaagtaacagaaaacccctacttgaattggcagataatcgtaacaataagggtatttatcatttcatataataggtgttgtataacatctttggctttgattctctgagactctcttccagctaacaacgataatgaggaaatgtatcgtttcatataactggtgttaagtctcatagcctggctctggttctctgacactccattctgccatgttccatgggttgacttcatcctaaaactgtgctgaatgatggatgcagttccaggcaaggggattatgggaataccataatcagtttcaatgaatcattttggtgaaatcatgttgagaaggcaatacaatgatacagtagacagtaaagccattattggtatcagtggctttaaggctaaccattccccaaactaactgtgtcccttcaattcacacccatgggatttgtgtaatgacggcccccaccttccaaagcagtgccactagaatgtgaacttatcaagatctgaaccttcttgtcttgctcattcattgttctattgtcagtgtctagcacaatgcctggacatggtagatactcaacaaatattggttgaatggataaattgctaaacaaatatcctgtggccacacccattgtggattgccttatcctctagtgtgaatttgttttagctctgaatgtctgatcaccctaaccagacatctacccttcccaggtaaccagcccagtggttctaaaagtacagtcccaggaccagcagcctcagcaccacctgagaacatgttaggaatgcaaactctcaagccccactccatacccgcagaatcaaaaactcttggggtgggacccagtaacctgtgttttagcagcctctcaggaggttccaatgaaggagaaaatttgaaaaccactggtccaggtagagctaccacttcactgagcatcaacagcatgtttggtccaaagactggccctgaagatgcttagataaaaaaagctaacattgaacctcactatatgccaggtattgtgtgtcacatgacttaactttgttcactgcttatttggcagctgaggaaactaaggctcacagagaaaaaaacaactttgcccaagaacacacatggcagagccaaggttgaaatccaacctaagtacataaaagcttgctttcatgtctgtgggagagacaggcaggcaaaaagataataataatacaatgtaagagaagcaaatgcagggtgtcatgggactcaggggaaggcactggcgcaagaccacagtgggtggaggttggccactttggggaggtgacagttgagttaactcacacagaatgaataagcgttggacaaaagggctcccagaagaacagcaagtgcaagagcccagggtccacagagagaatggcaggtagcttagcatggctgaagtgagactgtgaggagaacggataagaggatggaagctggggaggtggcacagatggatctcaaggacttggagtaaaaagtccatagtaacgagtttaaattgtctcttgacggcaatggggagccatggaagatatttgagctggagggtaacatagatttatattttggctgcaggtaggatctaatacaaaagcaattcaactaatattcactaagtgacctgagttatctgtgagatatttattataaggtgttaaacttctttgaagattgtaagaaagagataaaacctctaaatggttttgacccttcaaaggacatttaaatggttatttctaagtgtcataaacatggacttgggatttggcctcatcattcacccagatgattcatacccatgatcccaggctgtgaggtcttgagcaaattacttcttctcagagccttagtttgttcctctgtggaatgggaatgctaacagcacttacctcggaaagttgctgagaataaacgagaccgtgcatttagagcatgtaggcaccgtgtctggcaggtaatgagtgctcagtcagcttattgatgaggatgcagatgacctcagcctgagatagaacagatgtgttctctttcatggactgaaggccacccagactttgcgacatccttaaactttgccccagtttctccttatcctcataagcagttggctggctggcttatctagaaaaaagaaaggagggaggagaaaaagcaaagaaaaatgttcattttccctgctgttcaccccattctaaagtaaggcagaatttctggagagggggctcaggtccacccttggctatccttggttgtacagttgcatctacttataacggtggccaagtcgccatggcagtaggtgctgtggctgccctgccccatcgtcttcagactacccgagtttacctgcagcactgacagcttcccaccccaaaactcctcgttctttgcttttcctctcggtggctttctccaggggctgtaggagcttgtttagcccacctgcatggcattttgaaaatacctgaaattttatgccccgaaggacaattctcaatcagtgaaagatgggagaggaaaggtaaacacctcagctgccccatctctcagtgggacaatgttgaggggtcgtctttgtgttctctcaagggtcctcagcaagaccgagccacccgtcacccacagcagtaacatactcatgagcacgcccccccaccccaccttttgtgcttcctgggatcacttcccaaataaactacttgcacct

SEQ ID NO: 112071 - DNA, 882 bp, Homo sapiens
  Payload ID: 1956
  Gene Symbol: BCAS1
  Gene Name: breast carcinoma amplified sequence 1
  ENST ID: ENST00000422805
  CDS Start-End: 1-743
agaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaattcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgag

SEQ ID NO: 112072 - DNA, 1299 bp, Homo sapiens
  Payload ID: 1957
  Gene Symbol: BCAS2
  Gene Name: breast carcinoma amplified sequence 2
  Uniprot ID: O75934
  ENST ID: ENST00000369541
  CDS Start-End: 49-726
tgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactttgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtagatgaactagatgtatgtgaataaaaattatttggtcctcacaaaaa

SEQ ID NO: 112073 - DNA, 3531 bp, Homo sapiens
  Payload ID: 1958
  Gene Symbol: BCAS3
  Gene Name: breast carcinoma amplified sequence 3
  Uniprot ID: Q9H6U6
  ENST ID: ENST00000390652
  CDS Start-End: 32-2818
actagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccgggccttatctctttggagcggggtgtttttccataaaagccccatgcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaatcacgctgcagttggtgtccatccctga

SEQ ID NO: 112074 - DNA, 3496 bp, Homo sapiens
  Payload ID: 1958
  Gene Symbol: BCAS3
  Gene Name: breast carcinoma amplified sequence 3
  Uniprot ID: Q9H6U6
  ENST ID: ENST00000407086
  CDS Start-End: 49-2790
tgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaatcacgctgcagttggtgtcca

SEQ ID NO: 112075 - DNA, 3514 bp, Homo sapiens
  Payload ID: 1958
  Gene Symbol: BCAS3
  Gene Name: breast carcinoma amplified sequence 3
  Uniprot ID: Q9H6U6
  ENST ID: ENST00000408905
  CDS Start-End: 1-2808
atgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagacacagcccttgacgtagcagtaaaaaccttcccccctgagagacacgtggcagtgaagtgttttgaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaatcacgctgcagttggtgtcca

SEQ ID NO: 112076 - DNA, 550 bp, Homo sapiens
  Payload ID: 1958
  Gene Symbol: BCAS3
  Gene Name: breast carcinoma amplified sequence 3
  ENST ID: ENST00000587002
  CDS Start-End: 1-550
tcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcagtggactcttccaccgcccttgagtggggaacatccaggccttcacactcacgctcagcccatcacccctctgtgcaaggtgcaaggtcctctgcccacctgaagcctcaaggcctgatggaaaccatccacagccactctaggatgagtcaacattgcatgcagccagccatggccactgggagaagagtcagacatgggccatggagctgcaggctcacctgcccccggctgagtcaggaccgagcacaggacttgacagaggaggcatcgcagcaaggtacctttgacaggagcgtgaccctgctggaggtgtgcgggagctggcctgagggcttcgggctgcggcacatgtcctccatgg

SEQ ID NO: 112077 - DNA, 2948 bp, Homo sapiens
  Payload ID: 1958
  Gene Symbol: BCAS3
  Gene Name: breast carcinoma amplified sequence 3
  Uniprot ID: Q9H6U6
  ENST ID: ENST00000588874
  CDS Start-End: 189-2243
gccgccttgcagtttgatctcagactgctgtgctggcaatcagcgagactccgtgggcgtaggaccctccgagccaggtgtgggatatagtctcgtggtgcgccgttttttaagccggtctgaaaagcgcaatattcgggtgggagtgacccgattttccaggctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaatcacgctgcagttggtgtcc

SEQ ID NO: 112078 - DNA, 558 bp, Homo sapiens
  Payload ID: 1958
  Gene Symbol: BCAS3
  Gene Name: breast carcinoma amplified sequence 3
  ENST ID: ENST00000586241
  CDS Start-End: 29-139
agcgttaaccggcggggcggccggttttatgaatgaagctatggctacagattccccaagaagacccagtcgttgtactggtggagttgtggttcgcccccaggctgtcacatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaa

SEQ ID NO: 112079 - DNA, 633 bp, Homo sapiens
  Payload ID: 1958
  Gene Symbol: BCAS3
  Gene Name: breast carcinoma amplified sequence 3
  ENST ID: ENST00000590128
  CDS Start-End: 100-633
cggaaagggaactccctgaccccttgcgcttcccaggtgaggcaatgcctcgccctgcttcggctcgcgcacggctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaa

SEQ ID NO: 112080 - DNA, 545 bp, Homo sapiens
  Payload ID: 1958
  Gene Symbol: BCAS3
  Gene Name: breast carcinoma amplified sequence 3
  ENST ID: ENST00000588168
  CDS Start-End: 140-545
gagaattcgatgtaaacagaccagtctccctgtcctccggctccaacctgaaacgctcacgtgagcgggacaggagtctggatcatgttgcttttcttttcaaagccacgaaggttctgtcttccaaaaaaaatgttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtg

SEQ ID NO: 112081 - DNA, 594 bp, Homo sapiens
  Payload ID: 1958
  Gene Symbol: BCAS3
  Gene Name: breast carcinoma amplified sequence 3
  ENST ID: ENST00000588532
  CDS Start-End: 42-203
agagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacagaaatcaaatgtcgcaaaggaataagtctgctaagctgaagaagaatttgaaaatgttattgcttcaccacgttaaaggaaaggaaagcctgatacaggaaaaaaggaagttgtcctaaatgcaggatagcatcctggtttggatcctggagcagagaaaggacattagtgagaaaggcttccaggaagcagctgataggttgggtctagaagcttgataagagactaaaaaagtacagtaatactcacaccagtataattgccacaaacacctagcacttaatagttaaaggcttacagtggaacacctctaacagaagaaaaggagaaaatagtctgggtcagatttgaaaatgcagatttaaatgatacatcaagaaatctggaatttcatgaaatacatagtactgggaatg

SEQ ID NO: 112082 - DNA, 562 bp, Homo sapiens
  Payload ID: 1958
  Gene Symbol: BCAS3
  Gene Name: breast carcinoma amplified sequence 3
  ENST ID: ENST00000586705
  CDS Start-End: 128-562
ggtttgaatgtcctcccgtagctcagagtaattcgatcgtctgaagccttcttctctcagcttgtcaaagtcattctccatccacctttgttccgttgctggctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccat

SEQ ID NO: 112083 - DNA, 590 bp, Homo sapiens
  Payload ID: 1958
  Gene Symbol: BCAS3
  Gene Name: breast carcinoma amplified sequence 3
  ENST ID: ENST00000591147
  CDS Start-End: 73-243
atcactcggggagactccaaacagtgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttccaggaagcagctgataggttgggtctagaagcttgataagagactaaaaaagtacagtaatactcacaccagtataattgccacaaacacctagcacttaatagttaaaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttg

SEQ ID NO: 112084 - DNA, 3673 bp, Homo sapiens
  Payload ID: 1958
  Gene Symbol: BCAS3
  Gene Name: breast carcinoma amplified sequence 3
  Uniprot ID: Q9H6U6
  ENST ID: ENST00000589222
  CDS Start-End: 69-2855
ctcggggagactccaaacagtgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagacacagcccttgacgtagcagtaaaaaccttcccccctgagagacacgtggcagtgaagtgttttgggaaaaaaaaaggaaaaaaaaaacaatgccaacagcccagcgtccgtgagcaacccaacagtaacaaagcatgcgttcgggatggaggaagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaatcacgctgcagttggtgtcca

SEQ ID NO: 112085 - DNA, 747 bp, Homo sapiens
  Payload ID: 1958
  Gene Symbol: BCAS3
  Gene Name: breast carcinoma amplified sequence 3
  ENST ID: ENST00000586484
  CDS Start-End: 196-747
ggcaatgcctcgccctgcttcggctcgcgcacggtgcacggtgcgtgcacccactgacctgcgcccactgtctggcactccctagtgagatgaacccggtacctcagatggaaatgcagaaatcacccgtcttctgcgttgctcacgctgggagctgtagactggagctgctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttc

SEQ ID NO: 112086 - DNA, 918 bp, Homo sapiens
  Payload ID: 1958
  Gene Symbol: BCAS3
  Gene Name: breast carcinoma amplified sequence 3
  ENST ID: ENST00000592848
  CDS Start-End: 34-195
agactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacagaaatcaaatgtcgcaaaggaataagtctgctaagctgaagaagaatttgaaaatgttattgcttcaccacgttaaaggaaaggaaagcctgatacaggaaaaaaggaagttgtcctaaatgcaggatagcatcctggtttggatcctggagcagagaaaggacattagtgagaaaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttggga

SEQ ID NO: 112087 - DNA, 3559 bp, Homo sapiens
  Payload ID: 1958
  Gene Symbol: BCAS3
  Gene Name: breast carcinoma amplified sequence 3
  Uniprot ID: Q9H6U6
  ENST ID: ENST00000588462
  CDS Start-End: 1-2853
atgaatgaagctatggctacagattccccaagaagacccagtcgttgtactggtggagttgtggttcgcccccaggctgtcacagagcagtcctacatggaaagtgttgtgacttttctgcaggatgttgtgccacaggcttacagtggaacacctctaacagaagaaaaggagaaaatagtctgggtcagatttgaaaatgcagatttaaatgatacatcaagaaatctggaatttcatgaaatacatagtactgggaatgaaccgcctttgttgattatgattggctacagtgatggaatgcaggtctggagcatccctatcagtggtgaagcacaagagctcttctctgttcgacatggcccaattcgagcggctagaatcttgcctgctccacagtttggtgctcaaaaatgtgataactttgctgaaaaaagacccctccttggtgtttgtaagagcattggatcttctggcacaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccgggccttatctctttggagcggggtgtttttccataaaagccccatgcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagacacagcccttgacgtagcagtaaaaaccttcccccctgagagacacgtggcagtgaagtgttttgaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtaggtaccagcaacctgcttctgactggccagccccctcccctgctggaggaggggagaagccccgctctggtcctacccttcagtctctgctcttccttcatcaaccaccttccccaagcttagtgacagcagccgcccatcctacctggatggagaagagacccttctccaagcacctcagcgcacttgccctctgccacacctgtcggtggaggctgtggccaggagagactgtagaagctcggtccctgtgtatgtttgcatatgacatcctgcattggatccgcttttgtattttttaaccatacccacggtggggcgggtggggggagcctggaacagtgaccagatctgggggcctgagtggggacagagttgatcgtccacctggccattttgaccctgagtggacagtcacagcctcagctcatgtctggctgtgacacacactgcccccagcttcccttggtcagccccactccagcacggggtgaacggaggcccagagtactagggaaggaggaagggaggacatgcctcttcttcctcctttctttccccatctgttcatgggaagagtttgtctttcttatctttaagcccctttaccctggtcctgtactgatcagtgaaggaaaccgtggttactgaggccctgttgaaaagtgcacgtcttgtccaataaatcacgctgcagttggtgtcca

SEQ ID NO: 112088 - DNA, 2203 bp, Homo sapiens
  Payload ID: 1958
  Gene Symbol: BCAS3
  Gene Name: breast carcinoma amplified sequence 3
  ENST ID: ENST00000585744
  CDS Start-End: 104-2203
gccgccttgcagtttgatctcagactgctgtgctggcaatcagcgagactccgtgggcgtaggaccctccgagccaggctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccgggccttatctctttggagcggggtgtttttccataaaagccccatgcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggtacctttgacaggagcgtgaccctgctggaggtgtgcgggagctggcctgagggcttcgggctgcggcacatgtcctccatggagcacacggaggagggcctccgggagcgacttgccgacgccatggccgagtcacctagccgggacgtcgtgggatccggaacagaacttcagcgagagggaagcatcgagactctgagtaacagctcaggctccaccagcggcagcataccaagaaactttgatggctaccgatctccgctgcccaccaatgagagccagcccctcagcctcttcccgactggcttcccgtag

SEQ ID NO: 112089 - DNA, 1950 bp, Homo sapiens
  Payload ID: 1958
  Gene Symbol: BCAS3
  Gene Name: breast carcinoma amplified sequence 3
  ENST ID: ENST00000614888
  CDS Start-End: 1-1950
acaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccggcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggt

SEQ ID NO: 112090 - DNA, 1995 bp, Homo sapiens
  Payload ID: 1958
  Gene Symbol: BCAS3
  Gene Name: breast carcinoma amplified sequence 3
  ENST ID: ENST00000613443
  CDS Start-End: 1-1995
acaagcccaccgtactgttgtgtggatctgtattcacttcgtactggggagatggtcaagtccattcaatttaagacacctatttatgatctccattgcaataaacggatccttgtcgtagtcttgcaggagaaaattgctgcctttgatagctgtactttcacgaagaaattctttgttacaagctgctatccatgtccagggccaaacatgaatcctattgctcttgggagccgctggcttgcttatgcagaaaacaagttgattcgatgtcatcagtcccgtggtggagcctgtggagacaacattcagtcttatactgccacagtcattagtgctgctaaaacattgaaaagtggcctgacaatggtagggaaagtggtgactcagctgacaggcacactgccttcaggtgtgacagaagatgatgttgccatccacagtaattcacggcggagtcctttggtcccaggcatcatcacagttattgacaccgaaaccgttggagagggccaggtgcttgtgagtgaggattctgacagtgatggcattgtggcccacttccctgcccatgagaagccagtgtgctgcatggcttttaatacaagtggaatgcttctagtcacaacagacacccttggccatgactttcatgtcttccaaattctgactcatccttggtcctcatcacaatgtgctgtccaccatctgtatactcttcacaggggagaaactgaagccaaagtacaggacatctgcttcagccatgactgtcgctgggttgtggtcagtactctccggggtacttcccacgttttccccatcaacccttatggtggccagccttgtgttcgtacacatatgtcaccacgagtagtgaatcgcatgagccgtttccagaaaagtgctggactggaagagattgaacaagaactgacgtctaagcaaggaggtcgctgtagccctgttccaggtctatcaagcagcccttctgggtcacccttgcatgggaaactgaacagccaagactcctataacaattttaccaacaacaaccctggcaaccctcggctctctcctcttcccagcttgatggtagtgatgcctcttgcacaaatcaagcagccaatgacattggggaccatcaccaaacgaaccgggccttatctctttggagcggggtgtttttccataaaagccccatgcaaagttaaacctcctccacaaatttcacccagcaaatcgatgggcggagaattttgtgtggctgctatcttcggaacatccaggtcatggtttgcaaataatgcaggtctgaaaagagaaaaagatcagtccaaacaagttgtagttgagtccctgtacattatcagttgctatggcaccttagtggaacacatgatggagccgcgacccctcagcactgcacccaagattagtgacgacacaccactggaaatgatgacatcgcctcgagccagctggactctggttagaacccctcaatggaatgaattgcagccaccgtttaatgcaaaccaccctctgctcctcgctgcagatgcagtacagtattatcagttcctgcttgctggcctggttccccctggaagtcctgggcccattactcgacatgggtcttacgacagtttagcttctgaccatagtggacaggaagatgaagaatggctttcccaggttgaaattgtaacacacactggaccccatagacgtctgtggatgggtccacagttccagttcaaaaccatccatccctcaggccaaaccacagttatctcatccagttcatctgtgttgcagtctcatggtccgagtgacacgccacagcctcttttggattttgatacagatgatcttgatctcaacagtctcaggatccagccagtccgctctgaccccgtcagcatgccagggtcatcccgtccagtctctgatcgaaggggagtttccacagtgattgatgctgcctcaggt

SEQ ID NO: 112091 - DNA, 227 bp, Homo sapiens
  Payload ID: 1958
  Gene Symbol: BCAS3
  Gene Name: breast carcinoma amplified sequence 3
  ENST ID: ENST00000626960
  CDS Start-End: 66-227
ggggagactccaaacagtgagcctagagctggagactagcgttaaccggcggggcggccggttttatgaatgaagctatggctacagattccccaagaagacccagtcgttgtactggtggagttgtggttcgcccccaggctgtcacagagcagtcctacatggaaagtgttgtgacttttctgcaggatgttgtgccacagaaatcaaatgtcgcaaaggaataa

SEQ ID NO: 112092 - DNA, 1378 bp, Homo sapiens
  Payload ID: 1959
  Gene Symbol: BCAS4
  Gene Name: breast carcinoma amplified sequence 4
  Uniprot ID: Q8TDM0
  ENST ID: ENST00000358791
  CDS Start-End: 101-736
cactgggtggcgctgcccgctcggcccggcgctcctggagctgcgagccgcgaccgccgggagcgcacctgccccgcctccgccaggcggtccgcggggcatgcagcggaccgggggcggggctccgaggcccgggcgcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacgtggagtgcagtggcacaatcccagctcgctgcaacctccgcctcccgggttcaagtgattctcctgcctccgcctcccaagtagctgggattacagaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaatgtcgagatggggtctcactatgttgtccagactgatctcaaactcctgggctcaagtgatccacccaccttggccttccaaagtggtgggattatgggcaggagcctccgtgcccaggctgctgccattttcaaatttcctccctgcctcatgtgagaccacagggtttggagaagcagttggaacccacgtgtggtgatgcctcccacatcggcctgcttggggttctacaggggttgagggaccaggcctggccggggctgatggacagtggggactttccttctctccatgatggctttgcaggggctccatggtccttctctctgtgatgggtttttgcacggggtgtgctctgccactgtggtgggtgggtggatgctgcttctgttgcctccagacctcggtgcccacagccttgaggatccttccaataaaggtgtcaagagctca

SEQ ID NO: 112093 - DNA, 6680 bp, Homo sapiens
  Payload ID: 1959
  Gene Symbol: BCAS4
  Gene Name: breast carcinoma amplified sequence 4
  Uniprot ID: Q8TDM0
  ENST ID: ENST00000371608
  CDS Start-End: 1-612
atgcagcggaccgggggcggggctccgaggcccgggcgcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaatgtcgagatggggtctcactatgttgtccagactgatctcaaactcctgggctcaagtgatccacccaccttggccttccaaagtggtgggattatgggcaggagcctccgtgcccaggctgctgccattttcaaatttcctccctgcctcatgtgagaccacagggtttggagaagcagttggaacccacgtgtggtgatgcctcccacatcggcctgcttggggttctacaggggttgagggaccaggcctggccggggctgatggacagtggggactttccttctctccatgatggctttgcaggggctccatggtccttctctctgtgatgggtttttgcacggggtgtgctctgccactgtggtgggtgggtggatgctgcttctgttgcctccagacctcggtgcccacagccttgaggatccttccaataaaggtgtcaagagctcagccctggtctggtgtgagaatgacggggagtgatagtttccttttcacctgtgcagtgttttctagaaggttcctcctgtgcctcacctgcgagggcctgatcctgggcacctgctgatgaggctccagctgagggaggggtagtcccggcctttggatttccagcaagagtgcagaggtcattaggacccccagggtcttcaaaggcttgtttacccacatttcttcccatgcagatgagtttcctgctattgtcctaacactccggatttctcactgtggcttcaacctgcaatgggtatttctggaattcctcgaagagccaagaacacacacataattcccctatgcacatacaggactgaactgtaaatctgcattagaatttcaagataatctgcctgggcaaggtgactcatgcctgtaatcccagcatcttgggaggctgaggcaggagggtcgcttatgcacagggtcaagactgcagtgagccgtgattgttctactgcaccctagcatgtgcaacagagcaagaccctgtcccccacaccccaaaaaagtttttcaaggaagcctaaaataatgaatctggcaagatagagtagaggccaggtgcagcggctcatgtctgtgatcccagcactttgggaggccgaggcaggcagatcgcccaggagtttgagaccagcctgggcaacataatgagaccatatctctaccaaaaatacaaaaattagcctggcgtgctggtgcacatctgtggtcccagctacttgggaggctgaggtgggaggattgcttgagcctgggaggttgaggctgcagtgagccatgattgtgccactgcactctagcctgggtaaccaagtgagatcttggctaaaaatgtttttaaaaattaaaaacagaaaagcagggaaatagtttagacaatttttggaattcagagatataggtagaccccttgtttctggaaaagtcagcatttttattctcttttcttttttttcgagatggagtctcactctgtcacccaggctgtagtgcggtggcatgatctcagctcactgcaacctccgcctcccgagttcaagctattttcctgcctcagcctcccaggaagctgggattacgggagcacaccaccacgcccagctaatttttgtatttttagtagagacggggtttcgccatgttggtcaggctggtctcgaactcctgacctcaggtgatcctcctactttggcctcccaaggtgctgggattacaggtgtgagccaccatgcccggtcagcatttttttattgaggtgacttttacaattttttttttctttaaatgagacacctgtcacccagcctggagtgcagtggtgtgatcatggctccctgaaacctcaagctcctgggctcaagtgatcctcctgcctcagcctcccaagtagctgggaccacaaatgtgcaccaccatgcctggcaacttttcaaatttgttttattttttgtagagacagggtctccctatgttgttcaggctggtcttgaacttctgggctcaggggaccctcctgtttcggcctcccaaaatgtagtgttggcacaaacctttattgaagtataatttatattacagaaaggggtgcctaagtggttcactaaatttttcacaaactgagtgtatctatttaagcctcaccagactgagcaaccaacattatcagcactgagcagccccctcatgcccgcttctggtccatgcccatacccacccccaccccaggctgacagcatactgacatctaaccatatggactggagtttcttgtttctgtgctctgtataaagagaggacacacgggatgtgtacctacggtgtgtcatctcttgtctctggcctcaccggcttgatgttaccttgggaggtgtcactgttgctgtgtcactgtagatcattcccatggctgtgttgtattggctgggactgtttttatcgaagggagcttggacactctgcatgccccagtgtgctcagggagagcacacgttggatggaaagttggccgggtgaggtggctcacgcctgtaatcccagcactttgggaggccaaggtgggcagatcacttgaggtcaggaattcgagaccagcctggccaacatagtgaaacctcatctctactaaaaatacaaaaattagccaggtgctgtggtgcacccctgtaatcccacctactcgggaggctgaggcaggagaatcgctcgaatctgggaggtggaggttgcagcaagccaagatcgtgccactgcactccagcctgggcaacagagcgagaccctatctcaaaaaagaagaaaaaggagaaagctaatgttaattttttagacaagcagttgaggacactcatttccggaagggtgagtatctgctgagtgttgggcactcccaggcttctttctcctcccagcccctgaaacaggggccagggagagttggaaggaaatcccatgtgattaagccgcagcaacgttgagtgtcctaaagcagggacccacaggccccacgctaggagcatggccctgaggttagcctgcctggcagcactgtccgctcccatgcctcttagctgtgtgagctgggcttttcacttgctctctctgagtccagctgcccctgcggtaagacatgaggatggctctggtctgatgggttgtggtgagggtgacatgaggtgagctgtgtgcatgctgggcacactggcgaggggctctcagtaatgggaggctgctgttgcagggcccgggctgtgatggggaaagggttgattgtcctgcgtttctcagttgaccagcggcatccgagggcctgaacagcgagtgactcagggactgcccttacgtgtcagagttagaagtcatgggagaatggaggctgctctctctgggtttccctgtcctgttaggaggggtgaggttgcacaggaaatctatggggaaaaggtgacaagtgaactggaagtagccgttccaaagttcctaggatttgcactgccaaacaatgagctttaagggacgcttggaaacatctggggagaaggaaggccgggacactgcgccctgccatcaccaacccctaacctcagtcctctgagcggctccactgtccctgtgccaggtgacttcatgtgcgtcctcattaaagcaaagtgcctgacatttccattgtccagtcaatgatgtcctcggttgctgactattgatggcctctaaccccttggtaagggtaactgcagcctaggaaagggtgatctgatctttctcttttttaaacagagacggggttttgctatgttgtccaggctagtctcaacctcctgggctcaagcgatcctcctaccttggccacccaaagtattgggattacagtcgtgagccaccgaggcctgccagtctttttcttttgtggctgatgttggacagggacaccagtagaaaggtcactgcagatttcttcccaagagcaaggctcttcggtcaaccccctttcccactttcccagcggatgtgaacttcgtgctcaccaaagcaagaggtttcaaggtagcagcccatggggttgtatctgattggcagaaatgtgtggtttgccctgaattgttttaagatgttttcatgttgtgacaattgggtaaacttctggaaaaaatagagctccatacctcactcagcacacctggattgtaaatcgattaggagcttaatgtataaaatgaatctattggccgggtgcagtggctcacacctgaatcctaccactttgggaggccaaggtgggtggatcgcttgagctcaggagttcaagaccagcatgggcaacatagcaaaaccccttctctgtaaaaaatagaaaaattagccaggcatggtggtgcttgcctatagacccagctacttggtgggaggtgggaagattgctcgagccagggaacttgaggctgcagtgagctgagattgtgccactgcactccagcctgggtgacaaagtgttaccctgtcttagaaagtaaaataaaacgaatctattgaagaaataggttaaaaacattggcgaagtgtacaaaatcgagaagccataaaagaggtcaatttgattatataaaatttttaaacttctgcatggcaaaaccaacggaaaactcaaccaaaaaatcccaaaacaacaaaatcctaagcaaattcaaaagatagatgacaaattgggaaaatatatttgcatctcatgctacaaagggataatctccctaaaaaatgtcacctacaaaaaagggaaacagtagcaaaacaggcaaaggctatgaacaggagtttcacagaaaatgcaaaacatgaaaagatactcaaccttaatgtatgccaataagtatggaaaaataccctgagatttttcacatttcaggctggcaaggattaaaatttttgatgacactattgaatttttttttttttttgagacagagtctgctctgttgcccaggctggagtgcagtggtgtgatctcagctcactgcaacccctgcctcctgggctcaaatgatcctcccacctcaggcacccaagtagctgggattacaggtgcgcaccaccatgcccagctaatttttgtgtttttagtaaagatggggttttgccatgttggccaggctggtctcaaactcctggcctcaagtgatccacctgcctcagcctcctaaagtgctggaattacaggcttgagccactgtgcctggtcttgctggtgatattttgaagaaacatattcttgtacattgatggtgggacaccattctcatgggggggcaattggcatacctaacaaaattagaaatggtcctagctactcagtaggctgcggcagcaggatcgcttgagtgagcccaggaggttgaggctgcagtaagccgtgatcatgccactgcactccagcctggatgacaaagcaaaacccaatctcttaaaaaaaaaagggggggttgcggggggaaatgtcctcagacccagtaattccacccctaggaatccagcttacacacacaagaaagaaaagataaatgtacaaggttagtcactgcacagtgagacagcaaaagattagaaagaacccaagtgattattgatctgggttttattcctttatagcccaaccatatgatggaatactataatgttgtaaaaatgggttaagagttctttatgaattggtgtggaaacatcgccaagatatgaaagccaaatgcagaaaaatatatgtggtatgctattatctatgtgaaaaagacattactattctctggaaggataaacacaaatttgagaatggtggatatctggggtgagaggtatccttttcactgttctttaaaagttttgatattttggtgtttgcctattcaaaaaaatggttaaaatcagttgccaccaattaaaaattaggagaatgcatataaa

SEQ ID NO: 112094 - DNA, 365 bp, Homo sapiens
  Payload ID: 1959
  Gene Symbol: BCAS4
  Gene Name: breast carcinoma amplified sequence 4
  ENST ID: ENST00000445038
  CDS Start-End: 15-365
ccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagagaagtcacctgcaccggtgcccgtgacgtacgagctgcccacactgtataggacggaggactattttcctgtggacgccggggaagca

SEQ ID NO: 112095 - DNA, 1498 bp, Homo sapiens
  Payload ID: 1959
  Gene Symbol: BCAS4
  Gene Name: breast carcinoma amplified sequence 4
  ENST ID: ENST00000463943
  CDS Start-End: 14-283
cgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagagagttaaacagctaaaagaagtaaaataagaaggcaatgcttgtggaatgtacagtgcatattgacggcacacgcctcattacgattcgcctgcttgcttctcctgttcaatcgtttctttggaaggcagtggatttttctcttgcgtctctgtcttcttcagtttcgacttatcgaatttctcgatctcagccatatcggatttgtcagacatggttacggaggagaagcggagcgaggcacgcgagaacgagcgaagtctggtctgcgtagtggccaccactgagttgtccaattttatttatttttttgagacggagtttcactcttgtcgcgcaggctggactgcaatggcgcgatctcagctcactgcaacctccgcctcccgggttcaagccttcgtcaagatggttggacaccacgtcgccttcctggaagcagacgtgcttcaggctgagcgggaccatggggccttccctcaggccctgcggaggtggctgggatccgcagggctcccctccttcaggaacaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaatgtcgagatggggtctcactatgttgtccagactgatctcaaactcctgggctcaagtgatccacccaccttggccttccaaagtggtgggattatgggcaggagcctccgtgcccaggctgctgccattttcaaatttcctccctgcctcatgtgagaccacagggtttggagaagcagttggaacccacgtgtggtgatgcctcccacatcggcctgcttggggttctacaggggttgagggaccaggcctggccggggctgatggacagtggggactttccttctctccatgatggctttgcaggggctccatggtccttctctctgtgatgggtttttgcacggggtgtgctctgccactgtggtgggtgggtggatgctgcttctgttgcctccagacctcggtgcccacagccttgaggatccttccaataaaggtgtcaagagctca

SEQ ID NO: 112096 - DNA, 787 bp, Homo sapiens
  Payload ID: 1959
  Gene Symbol: BCAS4
  Gene Name: breast carcinoma amplified sequence 4
  ENST ID: ENST00000609336
  CDS Start-End: 54-599
gcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacgtggagtgcagtggcacaatcccagctcgctgcaacctccgcctcccgggttcaagtgattctcctgcctccgcctcccaagtagctgggattacagaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaa

SEQ ID NO: 112097 - DNA, 3466 bp, Homo sapiens
  Payload ID: 1960
  Gene Symbol: BCAN
  Gene Name: brevican
  Uniprot ID: Q96GW7
  ENST ID: ENST00000329117
  CDS Start-End: 337-3072
ccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgcccgagctctgcacccagaggaggacccagaaggacgtcaggggaggctactgggacgctggaaggcgctgttgatccccccttccagccccatgccaggtccctagggggcaaggccttgaacactgccggccacagcactgccctgtcacccaaattttccctcacaccctgcgctcccgccaccacaggaagtgacaacatgacgaggggtggtactggagtccaggtgacagttcctgaaggggcttctgggaaatacctaggaggctccagcccagcccaggccctctccccctaccctgggcaccagatcttccatcagggccggagtaaatccctaagtgcctcaactgccctctccctggcagccatcttgtcccctctattcctctagggagcactgtgcccactctttctgggttttccaagggaatgggcttgcaggatggagtgtctgtaaaatcaacaggaaataaaactgtgtatgagcccaggcaa

SEQ ID NO: 112098 - DNA, 2563 bp, Homo sapiens
  Payload ID: 1960
  Gene Symbol: BCAN
  Gene Name: brevican
  Uniprot ID: Q96GW7
  ENST ID: ENST00000361588
  CDS Start-End: 42-2057
gcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaaccaa

SEQ ID NO: 112099 - DNA, 807 bp, Homo sapiens
  Payload ID: 1960
  Gene Symbol: BCAN
  Gene Name: brevican
  ENST ID: ENST00000457777
  CDS Start-End: 167-807
gccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctggcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgag

SEQ ID NO: 112100 - DNA, 600 bp, Homo sapiens
  Payload ID: 1960
  Gene Symbol: BCAN
  Gene Name: brevican
  ENST ID: ENST00000441358
  CDS Start-End: 166-600
ggctcccagcaacgcctgcattttgcacattggtttgcatgactgtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgac

SEQ ID NO: 112101 - DNA, 844 bp, Homo sapiens
  Payload ID: 1960
  Gene Symbol: BCAN
  Gene Name: brevican
  ENST ID: ENST00000424639
  CDS Start-End: 151-844
cctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctggcctgcagcatggcccagctgttcctgcccctgctggcagccctggtcctggcccaggctcctgcagctttagcagatgttctggaaggagacagctcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcc

SEQ ID NO: 112102 - DNA, 790 bp, Homo sapiens
  Payload ID: 1960
  Gene Symbol: BCAN
  Gene Name: brevican
  ENST ID: ENST00000491823
  CDS Start-End: 1-80
agcacggcatcgatgacagcagcgacgctgtggaggtcaaggtcaaaggtggaggacattctacccacaatctaacttaagtccctcatgctgtagagggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccc

SEQ ID NO: 112103 - DNA, 1705 bp, Homo sapiens
  Payload ID: 1960
  Gene Symbol: BCAN
  Gene Name: brevican
  ENST ID: ENST00000479949
  CDS Start-End: 153-743
tgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggg

SEQ ID NO: 112104 - DNA, 2292 bp, Homo sapiens
  Payload ID: 1961
  Gene Symbol: BRF1
  Gene Name: BRF1, RNA polymerase III transcription initiation factor 90 kDa subunit
  Uniprot ID: Q92994
  ENST ID: ENST00000327359
  CDS Start-End: 331-2019
acaaccgagtcctgcgcgccccgtgcgccgggggtcgctcccaggccgaggtctgacagtgtcgccgaacgcgaaaggaagcgtgtggtacccgagagaggaagcaccctcgtcaccccggccggcaccgcattgaggcaggtgtgcaggtgcggttgcggcgagccaggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcat

SEQ ID NO: 112105 - DNA, 884 bp, Homo sapiens
  Payload ID: 1961
  Gene Symbol: BRF1
  Gene Name: BRF1, RNA polymerase III transcription initiation factor 90 kDa subunit
  ENST ID: ENST00000379932
  CDS Start-End: 397-801
ccgccaaggacacacccaccgaggccacagctgcgatttcatagtgtgggaccccactggcaaagacacgctggctgctgtggccgtggtttctgtcccagccgtctgtttccatagaaaaaggtaacgggcataagcagtttccaggagaaatacaaatggccagagtggagacagcctacatgtccatcagcaacagaaaggatcagcaggttgtggtgggtccatttggggaatgcagtgagaaggaataacttacagcagcacacaagacctgggcgacagctgtctccgggggtgccaggatagaattgctgagccgccagagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctccgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgc

SEQ ID NO: 112106 - DNA, 3314 bp, Homo sapiens
  Payload ID: 1961
  Gene Symbol: BRF1
  Gene Name: BRF1, RNA polymerase III transcription initiation factor 90 kDa subunit
  Uniprot ID: Q92994
  ENST ID: ENST00000379937
  CDS Start-End: 97-2049
gcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaaa

SEQ ID NO: 112107 - DNA, 3579 bp, Homo sapiens
  Payload ID: 1961
  Gene Symbol: BRF1
  Gene Name: BRF1, RNA polymerase III transcription initiation factor 90 kDa subunit
  Uniprot ID: Q92994
  ENST ID: ENST00000392557
  CDS Start-End: 893-2314
gggaggtgcgtggcatggggcactggctttgctgatgaggagaccagacttcagaggccgtgtcacctggcctgggccgcacagctggtgcatgccaagctcgcgtgcagacgaagctccagaggcctggctgtcaggagggttcctccccgaggacacacacgcaacctcctggaccgccaggctttagacttttaaaacttccatatgcaggaaaccccacaggacgcagccagcatctcgggtcatgggtgcacctgtcaccgcagtcctgggctaaacagtgaacaggagctctgtgtctctgtggtcgttacagttgtagtgaatgttccctgggagagtcctcttcagaagatatttgcggtattttcaacaaaggactctccaggatggaggagcaactacaagtcaggaaggaaaaggctgacaacccagttttttaaaaaacgggcaaaggacgtgaacagacaccatgcaatggcccagagtgcacaaatcatcatttctcccaggaatggggtgcccgagcccccaggcggctgaacttgagacttgtcacgtagtgttggtggaatgcagagcagctggagatcacctgctgcaggtgggtgcgtaactccgcacggccaagccgtttggaaagctgtagcatatgcatgagagtccggaaagttccgagagaaagtgtgtggatgcacccgccaaggacacacccaccgaggccacagctgcgatttcatagtgtgggaccccactggcaaagacacgctggctgctgtggccgtggtttctgtcccagccgtctgtttccatagaaaaagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaaa

SEQ ID NO: 112108 - DNA, 2368 bp, Homo sapiens
  Payload ID: 1961
  Gene Symbol: BRF1
  Gene Name: BRF1, RNA polymerase III transcription initiation factor 90 kDa subunit
  Uniprot ID: Q92994
  ENST ID: ENST00000440513
  CDS Start-End: 430-2184
ggcgacgcctctaaatgagagacagcgccaaccaggtacccgcgaggacgaccccgccccgcaggacagggcatctccaccgcgcgctggacggaggatacaaccgagtcctgcgcgccccgtgcgccgggggtcgctcccaggccgaggtctgacagtgtcgccgaacgcgaaaggaagcgtgtggtacccgagagaggaagcaccctcgtcaccccggccggcaccgcattgaggcaggtgtgcaggtgcggttgcggcgagccaggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggcgcgaccttagcatgccccggtgtgcgaaggctaaaagccagccccacttccctgtgctcgcccagtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaa

SEQ ID NO: 112109 - DNA, 2858 bp, Homo sapiens
  Payload ID: 1961
  Gene Symbol: BRF1
  Gene Name: BRF1, RNA polymerase III transcription initiation factor 90 kDa subunit
  Uniprot ID: Q92994
  ENST ID: ENST00000446501
  CDS Start-End: 277-1596
gtagaacatggcatagaagacggagctgccgacagccaagacgtactgggaggagaaagcgccgccgtgagcctggctctcccgcaggctgcgtgtcagccacacggcggacggggcggacggggcacgcgttccgagaggggccgccgctacccaccttgtgggcgggcaccgtcctggtcgcccccgggggccccacgacgaagtgcacgtcggccatgagctcgttgttgaacatgagcgcgttcctgcaaagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacag

SEQ ID NO: 112110 - DNA, 1452 bp, Homo sapiens
  Payload ID: 1961
  Gene Symbol: BRF1
  Gene Name: BRF1, RNA polymerase III transcription initiation factor 90 kDa subunit
  Uniprot ID: Q92994
  ENST ID: ENST00000548421
  CDS Start-End: 650-1276
gctcgccgctggagaccgcgctcactatccgaggaggaccctcctctgccccgcgtccagctttagtccccgactgcgttcatcgccaagggcccgcccactgccttaggtcgcgtcgccagccttgggtcccgtcgccagccttgggtcccgtccccggctgcactcaccgcgaggccccacccttagctctagtccccggtgtcgcccaccgacgaggccccgccccaaactccagtcccgggctgcgctcaccgccgtggccccgcccccaagcgccagtcctcggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtagacagcctccgtcctgcatctttccccacctggggttgtgacctgggggttgtgaccagggttgtgaccggggtgtaccccaggtgcctccacgcatctcagtggccggtctgtgctgcctgcccagtcaggaagttttggtctgtaggatgaggggccttcatgacatgggggtcacagtccgagacttgtgggagtgtgggtctccatggcaggagggcacctgccaatgctgggcacggttgggtgttagctaggcctgggtgaacagtgaacttttgtcctacacaaaggagattattttcaattaaaaaatttttttgtgagta

SEQ ID NO: 112111 - DNA, 824 bp, Homo sapiens
  Payload ID: 1961
  Gene Symbol: BRF1
  Gene Name: BRF1, RNA polymerase III transcription initiation factor 90 kDa subunit
  ENST ID: ENST00000551787
  CDS Start-End: 192-677
ccgccaaggacacacccaccgaggccacagctgcgatttcatagtgtgggaccccactggcaaagacacgctggctgctgtggccgtggtttctgtcccagccgtctgtttccatagaaaaagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgc

SEQ ID NO: 112112 - DNA, 1362 bp, Homo sapiens
  Payload ID: 1961
  Gene Symbol: BRF1
  Gene Name: BRF1, RNA polymerase III transcription initiation factor 90 kDa subunit
  ENST ID: ENST00000550375
  CDS Start-End: 1321-1362
acgctgcgtcagggccgcgccccgcgcgacgtcgctgcctcgcggccccgcccccaggcccgacatcctcgaagctgctcgagcttctgcccagcaaccggcgcgagccgcgcgctgtgcagaggtagccgtggaaggcggctcccggcgctggcaggcggccgcccccagacccgcagtgccatgcgcaggtgcttgcgcccgttcttcagttagcgatcttttggttaggaacgcaggtggacctgcttgtttggccatttgcattccggagtctgcctctggccgcggcctgtgggatggtcgttgggcttcctcgttcgttcagatgcttcgcgatttagcttgctacggacgccagcagccagcgcttgcagagagcgcggtccactctgctctgagggctttacaggggcaggcgctgctatttcccggcattttcctcgaggaaataggcacagagaggttagtcgcgcgctgaaggtcacacagccggcgggtgggcaagtcaggatctggccctgggcctgcagccctggagcttgggccccagggcgcgccctgcctctgtggctctgcctgtggatcgcagtcgcaggctcgctccttgtggggcctctagcctcccggcctggggctaatcctgggaggtgcgtggcatggggcactggctttgctgatgaggagaccagacttcagaggccgtgtcacctggcctgggccgcacagctggtgcatgccaagctcgcgtgcagacgaagctccagaggcctggctgtcaggagggttcctccccgaggacacacacgcaacctcctggaccgccaggctttagacttttaaaacttccatatgcaggaaaccccacaggacgcagccagcatctcgggtcatgggtgcacctgtcaccgcagtcctgggctaaacagtgaacaggagctctgtgtctctgtggtcgttacagttgtagtgaatgttccctgggagagtcctcttcagaagatatttgcggtattttcaacaaaggactctccaggatggaggagcaactacaagtcaggaaggaaaaggctgacaacccagttttttaaaaaacgggcaaaggacgtgaacagacaccatgcaatggcccagagtgcacaaatcatcatttctcccaggaatggggtgcccgagcccccaggcggctgaacttgagacttgtcacgtagtgttggtggaatgcagagcagctggagatcacctgctgcagacccgtgcctgtatattccacgctttgcgcacctgctggaattcggggagaagaaccacgaggtgtccatgactgccctgaggctcctacagaggatgaagcgggactgg

SEQ ID NO: 112113 - DNA, 3358 bp, Homo sapiens
  Payload ID: 1961
  Gene Symbol: BRF1
  Gene Name: BRF1, RNA polymerase III transcription initiation factor 90 kDa subunit
  ENST ID: ENST00000547530
  CDS Start-End: 60-2093
aggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaaa

SEQ ID NO: 112114 - DNA, 1962 bp, Homo sapiens
  Payload ID: 1961
  Gene Symbol: BRF1
  Gene Name: BRF1, RNA polymerase III transcription initiation factor 90 kDa subunit
  ENST ID: ENST00000549655
  CDS Start-End: 1260-1962
gcaccaccacgccctgcaaattttgtatttttagtaaagatggggtttctccatgttggtcaggccggtctcgaactgcggacctcaggtgatccgcccgcctcggcccccaaagtgctgggattagaggtgtgagccaccgcgcccagcctatgagcatattttttatcgttctctttatttctagctgcgatgattgtatcttattgaaaatcattaaaaatcttagcaattgttttaaattatctaatttttttctccaaataatatctattttagcagccaaatcaccacaaatcattggtttttatctttagttgtgggtgcacagcgggtgcgtgtattttggggcatgtgaggtgtcttgatgcgttcatgcagtgtgtaacagtcacatcagggtaaatgggacatctttcacctcaagcatttatccttcgtgttatggacaccctcagctggaaaggggggctgcgtcgtgagtatgaatggatgcaagtcatagccacctgagcctggtggggcacagcagggccctgtggagtcacatcccggcctcatgctcggcataggggagcgctgcttaggtccatgcagtcgctcagggcccaggctgtgcagcgcccagcctgtcctgctccaggcactcccccgtggcactgtgccgtgctggcagaggtgcacagcgccaggcctcagtgtgcacacacagcccccgtggcaccgccatgctggtagagatgccagaagtgggccctcctctcacccatgagtgtcagctgatgccggccggctggcgacttgtgtacccagcccacgcctgtcttgctctaagagtccccggaccgttgttgcgtgtggtgctgtctgcatggtctggagggaaggctgctgggtgtgcgcccctctgtgtcctgagcagggcggccatgcagtaggagcacgctgcctggccctagcgtgtctgcagcaggctggctggcagcaggtggccagtggctctcctgggttcggtgcgatggctgccctagctgagggtcagagaggctttgtccaggggaggggaactggtggggggcctgggggcctggaaagacaagtgcaggttgccccacccctgggctgcgtgggccgcctgtgcacgtgccatggcacatggaggtgggcactgaggtgctgtgtctgccgcagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgacccca

SEQ ID NO: 112115 - DNA, 600 bp, Homo sapiens
  Payload ID: 1961
  Gene Symbol: BRF1
  Gene Name: BRF1, RNA polymerase III transcription initiation factor 90 kDa subunit
  ENST ID: ENST00000550692
  CDS Start-End: 410-600
ggcgacgcctctaaatgagagacagcgccaaccaggtacccgcgaggacgaccccgccccgcaggacagggcatctccaccgcgcgctggacggaggatacaaccgagtcctgcgcgccccgtgcgccgggggtcgctcccaggccgaggtctgacagtgtcgccgaacgcgaaaggaagcgtgtggtacccgagagaggaagcaccctcgtcaccccggccggcaccgcattgaggcaggtgtgcaggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgcc

SEQ ID NO: 112116 - DNA, 1040 bp, Homo sapiens
  Payload ID: 1961
  Gene Symbol: BRF1
  Gene Name: BRF1, RNA polymerase III transcription initiation factor 90 kDa subunit
  ENST ID: ENST00000550208
  CDS Start-End: 906-1040
gcggccgcggcgctggcgggagcgtagagttccgccgccatcttcgcgggcggggcggcgggggcagcctcggcgcctgtggacgccgcgccccgcgccctcgcgccgcgccggggcctcgggagcggctctgcaagcaaaagcaaggaggtcaggcactgagcgacgcggccgtgcaggcaggctaggggcagcagcatgggcggcggcggcgctgtgacccgcggggctgccacccgctcccctgccacccccgcccctgcgaccctgcccgagcccagcctagcgcagcccggccaggcccggccgcggggggcgccgtcccgcccgcccgcccgcccgagcccgtacccgccgcggcgccggtgcgtcacgctgcgtcagggccgcgccccgcgcgacgtcgctgcctcgcggccccgcccccaggcccgacatcctcgaagctgctcgagcttctgcccagcaaccggcgcgagccgcgcgctgtgcagaggtagccgtggaaggcggctcccggcgctggcaggcggccgcccccagacccgcagtgccatgcgcaggtgcttgcgcccgttcttcagttagcgatcttttggttaggaacgcaggtggacctgcttgtttggccatttgcattccggagtctgcctctggccgcggcctgtgggatggtcgttgggcttcctcgttcgttcagatgcttcgcgatttagcttgctacggacgccagcagccagcgcttgcagagagcgcggtccactctgctctgagggctttacaggggcaggcgctgctatttcccggcattttcctcgaggaaataggcacagagagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtc

SEQ ID NO: 112117 - DNA, 778 bp, Homo sapiens
  Payload ID: 1961
  Gene Symbol: BRF1
  Gene Name: BRF1, RNA polymerase III transcription initiation factor 90 kDa subunit
  ENST ID: ENST00000552127
  CDS Start-End: 313-778
atagaagacggagctgccgacagccaagacgtactgggaggagaaagcgccgccgtgagcctggctctcccgcaggctgcgtgtcagccacacggcggacggggcggacggggcacgcgttccgagaggggccgccgctacccaccttgtgggcgggcaccgtcctggtcgcccccgggggccccacgacgaagtgcacgtcggccatgagctcgttgttgaacatgagcgcgttcctgcaaagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgt

SEQ ID NO: 112118 - DNA, 554 bp, Homo sapiens
  Payload ID: 1961
  Gene Symbol: BRF1
  Gene Name: BRF1, RNA polymerase III transcription initiation factor 90 kDa subunit
  ENST ID: ENST00000546417
  CDS Start-End: 1-554
gggccagttcgtgtccctggacggtgctggcaaaaccccgactctgggtggcggcttccacgtgaatctggggaaggagtcgagagcgcagaccctgcagaatgacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaac

SEQ ID NO: 112119 - DNA, 1530 bp, Homo sapiens
  Payload ID: 1961
  Gene Symbol: BRF1
  Gene Name: BRF1, RNA polymerase III transcription initiation factor 90 kDa subunit
  ENST ID: ENST00000619151
  CDS Start-End: 976-1530
cggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttga

SEQ ID NO: 112120 - DNA, 2603 bp, Homo sapiens
  Payload ID: 1962
  Gene Symbol: BRF2
  Gene Name: BRF2, RNA polymerase III transcription initiation factor 50 kDa subunit
  Uniprot ID: Q9HAW0
  ENST ID: ENST00000220659
  CDS Start-End: 122-1381
tggccggaagacgggggtgcaaccctttgaagtgtcccctcctacttcttgctgcctcacggttgctgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcagatttggatgtgttttctagcacttacatgcagatagtgaagctcctgggactggatgtgccatctctgtgcttggcagaactggtgaagacctattgcagcagcttcaaactgttccaagcttcaccttctgtgccagccaaatacgtggaagacaaagagaagatgctgtctcgaacaatgcagttggtggagctggcaaatgagacgtggctggtgaccgggaggcatcccttgcccgtcatcactgctgcgactttcctggcttggcagtcgctgcagcctgcagatcggctttcatgttcccttgcccgattttgtaaattggcaaatgtggacctgccctacccggcgtcctcccgcctgcaggagctgctggctgtgctgctgcggatggctgagcagctggcctggttacgagttctgagacttgacaaacggtctgtggtgaagcacatcggtgaccttctccagcaccgccagtcactggtccgctctgcctttcgggatgggacagcagaagtggagacccgagagaaggagccaccggggtggggacaggggcaaggagaaggggaggtgggaaataattccttaggtttaccccaggggaagcggccggccagtcctgcccttctcttgccaccctgcatgttgaagtccccgaagcggatctgccctgtaccccctgtctccactgtcactggagatgagaacatttctgatagtgaaatagaacagtatttgcgtacccctcaggaagttagggactttcagagagcccaggctgctagacaggctgccacgagtgtccctaaccctccctgatggatatccactgggagcacttcatcctgttctgacagcttgataacattcctgttataaccaaggatggaagtgtacaccagtccgtaggtattgcttttcttgtttgaaggaaccaagaggggctctgccattagttggaccctgggtcctggagtaaagtcaggagtgcagggatgactataggtaggagagattcccatcccttggtgtgggagagcaagttgcctatgtccatgttctgtgagatggctttcctcatagatggatgggaaaatgtcaggctctttgctgctggtttgaattggacacactgctgcggctcctcctgcaggcctgagggggcttccctctgcttgtggagtggttggcattcccagcagtatcaaccctcagaggagcgggaactggggaattctggccctacgtgcattcacaggcaatgatgggtttgtgtgtatggtgtcatgagatcctctacctcataacaaaaggacagtgggtagactaaggcagtagctcaaagggctttgcaaaattttaatatattaaaacaagaggcatctgctagaaaacattctattgtataaaacccgagttcttaaaaacatgttttctttggcactttcattccctccctcccctttccccagcatattgcaaaaagctctccagtgctaaggcattggcagggtgtgtaaacagcagccagcatatgtggaagaataatacaaagcttttttttttcttctaatatgtctgtgcagcaagcataaataacaggacccattccaaggagtgtgtgtgggttttccccctcccctgtgtcctctgtcaccttggtgatgaggccagagtgatgtgaagactgggagggaaccctaggtcagaccttggtttcctgttgttcttcccaagacccagggttccctcggtttccatttggtcctgtagtgaaatgctggtggttggttttaggttggggaaaagacgggtgctggtgtttaaaaggagtaaaggcataggcccctcatgacctgcagggaccccagccactgcctctgggcttggcttgagctcctgggagtcgggaagctggtttgacattttgtaggtttctctctactgtggagctggagatcaaatgattgggatggttcttcctctggccttacggaggcaaggaagtgctcttccttagtcccgtggtgttgtaaggctg

SEQ ID NO: 112121 - DNA, 473 bp, Homo sapiens
  Payload ID: 1962
  Gene Symbol: BRF2
  Gene Name: BRF2, RNA polymerase III transcription initiation factor 50 kDa subunit
  ENST ID: ENST00000522539
  CDS Start-End: 72-290
gctgcctcacggttgctgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcaacgagaatgactataccaagtgtcactcctgtctatgcagaaaggtacataatttgtgcatctgatatctgaggtctccggcgagtgagagacctttgtcgagttctgcagttgccaccaacatttgaggataccgcggttgcctactaccaacaggcatatcggcactctggcatccgagcggccaggctgc

SEQ ID NO: 112122 - DNA, 1192 bp, Homo sapiens
  Payload ID: 1962
  Gene Symbol: BRF2
  Gene Name: BRF2, RNA polymerase III transcription initiation factor 50 kDa subunit
  ENST ID: ENST00000520601
  CDS Start-End: 56-664
tgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcagatttggatgtgttttctagcacttacatgcagatagtgaagctcctgggactggatgtgccatctctgtgcttggcagaactggtgaagacctattgcagcagcctggagtgcagtggcaccatcatagctcactgcagcctggaactcatgggctcaagcgatctgcccacctgatcctcccaaaatgcagcttcaaactgttccaagcttcaccttctgtgccagccaaatacgtggaagacaaagagaagatgctgtctcgaacaatgcagttggtggagctggcaaatgagacgtggctggtgaccgggaggcatcccttgcccgtcatcactgctgcgactttcctggcttggcagtcgctgcagcctgcagatcggctttcatgttcccttgcccgattttgtaaattggcaaatgtggacctgccctacccggcgtcctcccgcctgcaggagctgctggctgtgctgctgcggatggctgagcagctggcctggttacgagttctgagacttgacaaacggtctgtggtgaagcacatcggtgaccttctccagcaccgccagtcactggtccgctctgcctttcgggatgggacagcagaagtggagacccgagagaaggagccaccggggtggggacaggggcaaggagaaggggaggtgggaaataattccttaggtttaccccaggggaagc

SEQ ID NO: 112123 - DNA, 550 bp, Homo sapiens
  Payload ID: 1962
  Gene Symbol: BRF2
  Gene Name: BRF2, RNA polymerase III transcription initiation factor 50 kDa subunit
  ENST ID: ENST00000521170
  CDS Start-End: 79-297
acttcttgctgcctcacggttgctgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcaacgagaatgactataccaagtgtcactcctgtctatgcagaaaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcag

SEQ ID NO: 112124 - DNA, 6648 bp, Homo sapiens
  Payload ID: 1963
  Gene Symbol: BRI3BP
  Gene Name: BRI3 binding protein
  Uniprot ID: Q8WY22
  ENST ID: ENST00000341446
  CDS Start-End: 92-847
gagcgcgccaaccttgccctagccggagcccgctgcggcccagcgcacggccctcaccccgcatcgcgaccccgcgccccgccggccgagcatgggcgcgcgcgcctcaggcgggcccctggcccgggccgggctcctgctgctgctgctgctgctgctgctgctcgggctgctggccccgggcgcgcagggggcgcggggccgcggcggcgcggagaagaacagctaccgccgcacggtcaacaccttctcccagagcgtcagcagcctgttcggcgaggacaacgtgcgcgccgctcagaagttcttggccaggctgactgagagatttgtgctgggagtggatatgttcgtggagacactgtggaaagtctggaccgagctcttggatgttcttggacttgacgtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaagtgaaggtcagccggccgggcgggtccacagttaccagcacgctgtctcagaaaacgaaaacggaggaaaaaaaccccaaaccccaaacaatcttaataaacacgactgagcaagaaagtggcgctgtgtagggctatttccacccacccggcagctcttaggacacattcccagaagagcggaaagatcattgacgtggaactacacacgaagtgtaattagtgggggaaaaaatattttttaaacaaaggatataaccatatttagttgtacagtaagagaaatttatctgtgcatagagcataaagttaattttttcaagcatttaaatacatcttttgtaaggttttttaataaaggcagattgagtcaagtttattaaaactttacatggaggggaagaatatgctaatttgacatttgagaaaagtttaaatgcgagcgtttgttttcacagcttagggattggtgggtgaggtctgtgtgcgttattttcatgttcccaaactgtgagctttatttcatgttatttttggtggatgttgacttagttcatgaatgttgtcacttctaaatgtggacagttgggctgcaggatgcaactcaacctcttttggatcctagagacccctgccaagcccccatcagtcctatttttaaatgaagacatcgccatttctagaagacctgagattttcttccctctgtgcttcgatgtattttaacctcaacattttgaaacggaaaatgcaaggaggggccaagaaatgtcctggggatttgatgccaggaagtacctggtaaggattggagattgctccagaatctactgcatgtcccaatttgcagtttgctcactagggctatatacaaaagctatacccttgagggtttttttttttttcttttgatttcctcaggaccttagagggaaaacaaacagtagcagctaatattctcaagtatattgctgcttagaaagatcctcaggaacaattagcagcaataagcaagcctttgaaaagatctgaattctttttcctgaaatatttacgatacacaggtgctttttatctgaaatctgttgtgtcctccttttaggcagtctctgtgggcagagagtgggacttgcgaggtggacagctgtggggatcctgggcaagggagtttcagaaggtgtggctcaggggctggtagaaacccccttttgttaggacttgttttttaaaaaagaaagccctaggccaggcgcagtggctgatgcctgtaatcccagcgctttgggaggccgaggagtatggatcacctgaggtcaggagttcaagaccagcctggccaacatggtgaaacccccgtctctactaaaaatacaaaaattagtcaggcatggtggtgggtgcctgtagtccagctactcaggaggctgaggcaggagaattgcttgaacctgggaggtggaggttgcggtgagccgagatcacgccactgcactccagcctaggcaacagagcaagacttcatcttaaaaaaaaaaaaaaaagcccagcattttgcagctttgaagctgctggggatcacgactgtctctgtggcccttacctggccacagatgtaccctggcaacccgctcacagtgccctgcgtgcaggtttatagataacccctgccagacctgctacaaccaagaccttatggtccaggtctcagtttggagaagatttagctgtctaccacttcttgtgtagtgttcctgtgaagttttatttttggttgcaagtatctggaaaacagatgcagatgtttttgtggatgttgttgagacttttgagacttctgtttctaaggtacacatgatgggacccaaactctcctggagagttccattcacttcctgaaacgtgcacctgtttcaggtgcatgtttattcagtgtgcatggatatttaagatttgctggagcaggctgggcagggtggctcacccctataatcccaacactttgggaggccaaggcaggtggatcacctgaggtcaggagtttgagaccagcccggccaacagagtgaaaccccgtctctactaaaaatacaaaaattagccaggcctggtggtgggcgcctgtgatcccagctacttgggaggctgaggctggagaatcgcttgaacatgggaggcggaggttgcagtcagctgagatcataccaccacactctagcctcagcaacagagtgagactccgtctcaaaaaaaattatttgctggatcgaatctttttttttttgagatggagtctcactgtcaaccaggctggagtgcagtggcaccatctcggctcactgcaagctccgcctcctgggttcacgccattctcctacctcagcctcccaagtagccgggactacaggcgcccaccatcatgcccggctaattttttatatttttagtagagacggggtttcaccgtgttagccaggatggtctcgatctcctgacctcgtgatccgcccgcctcggcctcccaaagtgctgggattacaggcgtgagccaccgcgctgggcctagatcaaatctttatccatgcacattggaacacaggattactgggttgaaatcattctagttttgtcatttagatacttgtagatgaatctattttagcacaaggtataaataactcgggaggtcatctctatcttctttccttttgtgcatttggctataccacgtttaggtactaaaacagctttgcttatgttggccaggggaaaacatggcattctgtgcgcaaagctaatgatcgccagccctgccttggcccctcccttgtttatggtcattgtaagatgcccgcatgttaaggcttaagctgtcactgggctgggtgtaatacccgcttcattcctcctcccaccctcttacccgaaacatgaagggcactgtgctctattgagatctcgataagatcatcattttaacttgtattcaactgagggaggtaacatgatatctgggtgctggtggattgagacctcaagcatcaattcaaaattgctgtcgaaaatatgcactattttttttttccactctggctaagtgtaggctctgaagccagttttatagcttgatacattctggtgaaagatgtcttcatttttaatgaaagaacctacagttagtaggtgtcacctcagggtagaaattctgatagaaattctgattatttgaaactctgatagaaatcctagatgctagatttgaagaaaacctgggttttattgcatagatttcaccttttctggggcacatcttaccccaaaataattggggatttttttgttccttctccattccatggaaccttgtagggtgttgggattgggcctcccctcgccacccgccacatgtctttgtttttttctctcttttgtatgtggaaaaatgtatttttgtaccatatctcatacctggagagaaaccttttttctatcttcagggctgtagaatatattagcgtaacacttcactgaatgtgacgtaaaagcattctgatgaaaactggttctgttataattaagactcagtgtttaaaatatcttaatcagtgttaatttcccagtgtttcagtatcacagtaaatacttgttttactgagaacagaaaataatccagaaaaggaaaaggaccagccctctctagattgctggaattgtatggatgtgttggggttggtttagtgatctcttccttgacaccctagcaaagatgcttttgtggagtgcaaacctttcataaatatactttccaggctgggtgcagtggctcaagcttgtaatcccagcactttgggaggccaaggcgggtggatcacttgcggtcgggagttcgagaccagcctggccaacatagtgaaatcccgtctctaccaaaaaatacaaaaaaaaaaaaaaaaaaaaaaatagccaggtgtggtggtgggttcctgtagtcccagctactcaggaggctgaggtgggagaattgtatgaacctgggaggcagaggttgcagtgaactgagatcacaccactgtactccagttgaggcgacagagtgagacccagtctcaaaaaaaaaaaaaagtgtgtgtgtgtgtatatatatgtatatatatatacacacacacacactttccaataccagtcggcattacccgccctttggtttcttttgctttggatttcagcccccatatcatttctggtaacagagcacagcaatagaatttctgggaagcagaccttgtgaatcgtgcctgtgtcttaattcacaaagggtaagtgaatgccgttgaaaggtgtttcatacacttaccccagaaatgagagcctgtctcatgcaggagtcgggaggcagcgatgtcagggaactgggactatgtctttatgactgtgatggtggtaaccaagtggggtggtcccctctggggagctgagtaagaacgcaaaggtttgggtcagtgattaggaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgaggctcctaaggggtcagctgccccactcctgacttttttatttttaatggtctataccttctgcaacatttttgtttatggccatttgaatagttggactttgactcctcacttgtgaataataggaatatattttgcagaatctaacataatacccttaaaattcatactggacaaccatcagtgtgatgtatagtatctggtgtaaacaaattttattcagcatattaaattattctgtgttttgcttttccttgatatgtaggaggtgcaccagtaccagtttttctcttgtggtggcttaaaacgctgattgccatttgcattgtctactgaaaagctgtggcagcgagtggtattattgaccatgtgttctcatgtctttttgcagatttaaaggttttattgtagtgtccatttaatatctgcatgtgtgtttaatctctgaataccatgtaattaaactgattaacttgtgatggtgatggtgattagcacacactaaaaacccaatgaagcaattgtctccctcttcttaactggaaatcacacttgtgaggtatggtatccattatcaacagtggattcatgattgacttcatattttgtgtatctggttataaattttgtatagcatttaatttggcacttaatataaatccatttgatttgaatagtgtgtgtgtgtacatggtgtgtgtgtgtgtgtgcactttagtttcgtgagccttgggaaactgattctacaaatatcttatatagagataaatgtatcaggcatttttttgcaaagcgatatatacattcctcttatttattaaatcactggctttggtgttatgtagagatatttgtagatctcagaacagaattaaaatattgtgaaaattacagcttaataaatgtttattgtaattttgttgtatggacttttaaaatatatctcatcacttctaaccaaa

SEQ ID NO: 112125 - DNA, 1913 bp, Homo sapiens
  Payload ID: 1964
  Gene Symbol: BRICD5
  Gene Name: BRICHOS domain containing 5
  Uniprot ID: Q6PL45
  ENST ID: ENST00000328540
  CDS Start-End: 1118-1804
tgccgtctcaccacgggtgggaggactcaaagtagatgggtaactggggttccaactccagagctggaatgccaactgcccactcccagcctggttcagaggaagatgttttgaagaatgagggaaagccaggcacaaagggaagccagggaagcaaagggccctggagtgaagctggtgggctgccgtgtcagagcgcccagggcagggagcagagctcagaagtaatgctggcccgggcgcagtggctcacacccgtaatcccaacgctttggaaggctgaggcaggtggattacttgagatcaggagttcaagaccagcctggccaaaatggtgaaaacccatctctactaaaaatacaaaaattagcgggacttggtggcatgtatctgtaatcccagctactagggaggctgaggcatgagaattgtgtgaacccgggaggcagaggttgcagtgagctgagatcacgccactgcactccagcctgggggacacagcgagactccgtctcaaaaaaaaaaaagttgggctaggcgggcccccgaggctggcctgactgtcccaggggcacaggctccagcaggctgcctgtctgtggtccaggcttcaggaacccccggtcttgggtgtgcgggggctgggaagtggctgggggtgcacagtcccacacctgtcattcactgaacaggcacgtattgacagcttgtggcgtgtcaggccctgtgcccaactctgggagtcaaggataacctgacagactcaggccactttaggaaaacgaaatccaccccaaccacacttagcgagtcaccctggccgggcctgggctgccctccagtcggtcagccggactggatttccacgcggccgagccctacgcctcccagaccctgagctccagtctgcacaggccaggtgtctggagccgggcctggtgacaggcatcccccaggtgggaggaggggctgtcctggctctgacctggatatcagatccagagctgagggggaggcgcagggtcaggaggggaggggttctgttctgagtttcccctggccaaggctgcagacaagggacgcagacaatcggcacattgtgagcaggggctgcaggatggaaccagcaagctgctgtgctgagcgccccaaacctgggcctacaggggtgaagaccaagccctcctgcgggggctggagagccgtgagcctgctcctgctgctgctgctgctggtgctggccgctgtgggggttgtggctggagggcttcttggctctgctcagggccctcccaagccaaggctgcagacgctgcgaatgaccctcccgagcccccacatgccccggcccaaccaaaccatcctggtggacgtggcccggaacgcggcgaccatcacagtgaccccacctcagagcaaccacagctgggcggtgctgttcgacgggcagagcggctgcatctgttaccgccctgaggagcaccaggtctgcttcctccgcctgatggaggacagtgatcgggagaccctgcggctgctggtggatacctccaaggtccaagaggcttgggtccccagccaggacacccaccacacccaggagctgctggcagtgcaggggagcctcgaagtggaccccgcccaggcgggggctttggtgcagcgcctgtgcatgaggacccccatctactgggcccggcgagcagaggggccccggagacagcggctgatttatctctgcatcgacatctgcttcccgagcaacatctgcgtgtcggtctgcttttattacctcccagactgagcccccgacctggcccagcctggcccgtccccaatccagtgggctggccaggccacctgcaccagggaggacagctgctggcagggactaataaacccttccacctggc

SEQ ID NO: 112126 - DNA, 783 bp, Homo sapiens
  Payload ID: 1964
  Gene Symbol: BRICD5
  Gene Name: BRICHOS domain containing 5
  Uniprot ID: Q6PL45
  ENST ID: ENST00000562360
  CDS Start-End: 1-783
atggaaccagcaagctgctgtgctgagcgccccaaacctgggcctacaggggtgaagaccaagccctcctgcgggggctggagagccgtgagcctgctcctgctgctgctgctgctggtgctggccgctgtgggggttgtggctggagggcttcttggctctgctcagggccctcccaagccaaggctgcagacgctgcgaatgaccctcccgagcccccacatgccccggcccaaccaaaccatcctggtggacgtggcccggaacgcggcgaccatcacagtgaccccacctcagagcaaccacagctgggcggtgctgttcgacgggcagagcggctgcatctgttaccgccctgaggagcaccaggtctgcttcctccgcctgatggaggacagtgatcgggagaccctgcggctgctggtggatacctccaaggtccaagaggcttgggtccccagccaggacacccaccacacccaggagctgctggcagtgcaggggagcctcgaagtggaccccgcccaggcgggggctttggtgcagcgcctgtgcatgaggacccccatctactgggcccggcgagcagagggtgagtcaggaccgctgtgggggaaggccaggccctcgggatggtttgaggagctgggggcggagcccttggagattcacggcaccctcgccacagggccccggagacagcggctgatttatctctgcatcgacatctgcttcccgagcaacatctgcgtgtcggtctgcttttattacctcccagactga

SEQ ID NO: 112127 - DNA, 555 bp, Homo sapiens
  Payload ID: 1964
  Gene Symbol: BRICD5
  Gene Name: BRICHOS domain containing 5
  ENST ID: ENST00000566018
  CDS Start-End: 73-534
ctgagtttcccctggccaaggctgcagacaagggacgcagacaatcggcacattgtgagcaggggctgcaggatggaaccagcaagctgctgtgctgagcgccccaaacctgggcctacaggggtgaagaccaagccctcctgcgggggctggagagccgtgagcctgctcctgctgctgctgctgctggtgctggccgctgtgggggttgtggctggagggcttcttggctctgctcagggccctcccaagccaaggctgcagacgctgcgaatgaccctcccgagcccccacatgccccggcccaaccaaaccatcctggtggacgtggcccggaacgcggcgaccatcacagtgaccccacctcagagcaaccacagctgggcggtgctgttcgacgggcagagcgtgagtgggcagggaggggtcaccctggcaggtgtcggtctggggggccccgcctcacccccctgcctccccagggctgcatctgttaccgccctgaggagcaccaggtctgcttcctccgcctgatggaggacagtgatcgggaga

SEQ ID NO: 112128 - DNA, 1233 bp, Homo sapiens
  Payload ID: 1965
  Gene Symbol: BRK1
  Gene Name: BRICK1, SCAR/WAVE actin-nucleating complex subunit
  Uniprot ID: Q8WUW1
  ENST ID: ENST00000530758
  CDS Start-End: 111-338
ccgagaattcgtgggtgctcaagaggatgggtgtggcctggcagcgcaggcgcactagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgtgaacagtctttgtctcctccccacctttggtgggaagtgcggggcagtcctggtcaagacactcatgccctggcaatgtggctgccagagaatgttgttgctaacccaccagtttcttgttgatttggagaggtcaaggccaggcccccacttggcttgaagggacattttcagacttttctttctgtcacttggagtgtctatgcctctcatatttccctaataaactcctcaactttttatctgactgctgtgattatggtggggagaggagctagagatgggttcacttattgcacagaaatgtaatacatggcgttattattctaacataaaactttcagatgtagctgtttgattcaaagcctaggtggcttaccagcccaagtccccatgtttggactttcagctgactagctcatcttgggaatcatttggtcattcagcacatttaccaagtatttactatgtaggcatgttaaactccaataaaacatacagcattgaatcaga

SEQ ID NO: 112129 - DNA, 2074 bp, Homo sapiens
  Payload ID: 1966
  Gene Symbol: BIN1
  Gene Name: bridging integrator 1
  Uniprot ID: O00499
  ENST ID: ENST00000348750
  CDS Start-End: 346-1575
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 112130 - DNA, 2338 bp, Homo sapiens
  Payload ID: 1966
  Gene Symbol: BIN1
  Gene Name: bridging integrator 1
  Uniprot ID: O00499
  ENST ID: ENST00000259238
  CDS Start-End: 346-1839
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 112131 - DNA, 2209 bp, Homo sapiens
  Payload ID: 1966
  Gene Symbol: BIN1
  Gene Name: bridging integrator 1
  Uniprot ID: O00499
  ENST ID: ENST00000352848
  CDS Start-End: 346-1710
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 112132 - DNA, 2365 bp, Homo sapiens
  Payload ID: 1966
  Gene Symbol: BIN1
  Gene Name: bridging integrator 1
  Uniprot ID: O00499
  ENST ID: ENST00000351659
  CDS Start-End: 346-1866
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaagcctgtctcgctgcttgagaaagccgccccccagtggtgccaaggcaaactgcaggctcatctcgtagctcaaactaacctgctccgaaatcaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 112133 - DNA, 2401 bp, Homo sapiens
  Payload ID: 1966
  Gene Symbol: BIN1
  Gene Name: bridging integrator 1
  Uniprot ID: O00499
  ENST ID: ENST00000346226
  CDS Start-End: 346-1902
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 112134 - DNA, 2693 bp, Homo sapiens
  Payload ID: 1966
  Gene Symbol: BIN1
  Gene Name: bridging integrator 1
  Uniprot ID: O00499
  ENST ID: ENST00000316724
  CDS Start-End: 413-2194
tccccgccccggggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaagcctgtctcgctgcttgagaaagccgccccccagtggtgccaaggcaaactgcaggctcatctcgtagctcaaactaacctgctccgaaatcaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagtttgaggccccggggcctttctcggagcaggccagtctgctggacctggactttgaccccctcccgcccgtgacgagccctgtgaaggcacccacgccctctggtcagtcaattccatgggacctctgggagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 112135 - DNA, 2497 bp, Homo sapiens
  Payload ID: 1966
  Gene Symbol: BIN1
  Gene Name: bridging integrator 1
  Uniprot ID: O00499
  ENST ID: ENST00000357970
  CDS Start-End: 346-1998
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaagcctgtctcgctgcttgagaaagccgccccccagtggtgccaaggcaaactgcaggctcatctcgtagctcaaactaacctgctccgaaatcaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagtttgaggccccggggcctttctcggagcaggccagtctgctggacctggactttgaccccctcccgcccgtgacgagccctgtgaaggcacccacgccctctggtcagtcaattccatgggacctctgggagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 112136 - DNA, 1832 bp, Homo sapiens
  Payload ID: 1966
  Gene Symbol: BIN1
  Gene Name: bridging integrator 1
  Uniprot ID: O00499
  ENST ID: ENST00000376113
  CDS Start-End: 59-1333
cgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 112137 - DNA, 2293 bp, Homo sapiens
  Payload ID: 1966
  Gene Symbol: BIN1
  Gene Name: bridging integrator 1
  Uniprot ID: O00499
  ENST ID: ENST00000393040
  CDS Start-End: 346-1794
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 112138 - DNA, 2272 bp, Homo sapiens
  Payload ID: 1966
  Gene Symbol: BIN1
  Gene Name: bridging integrator 1
  Uniprot ID: O00499
  ENST ID: ENST00000393041
  CDS Start-End: 346-1773
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 112139 - DNA, 2143 bp, Homo sapiens
  Payload ID: 1966
  Gene Symbol: BIN1
  Gene Name: bridging integrator 1
  Uniprot ID: O00499
  ENST ID: ENST00000409400
  CDS Start-End: 336-1655
cctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaa

SEQ ID NO: 112140 - DNA, 2115 bp, Homo sapiens
  Payload ID: 1967
  Gene Symbol: BIN2
  Gene Name: bridging integrator 2
  ENST ID: ENST00000452142
  CDS Start-End: 1-1654
agaaaaccacagggcgcggggccagggcggcggcccccagggagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatgggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctaactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgacta

SEQ ID NO: 112141 - DNA, 1990 bp, Homo sapiens
  Payload ID: 1967
  Gene Symbol: BIN2
  Gene Name: bridging integrator 2
  ENST ID: ENST00000544402
  CDS Start-End: 154-1773
ctgtttctctctttcaagcccggctcgggtgtcctgcctgctttctgcactctatccctaccagttccaggcttagagcctacctggagcaagaaacgcagtgtacatggcggcttcgcatgcatactcagagaacctaaacgtgttttcgatatggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatggaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctaactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactca

SEQ ID NO: 112142 - DNA, 467 bp, Homo sapiens
  Payload ID: 1967
  Gene Symbol: BIN2
  Gene Name: bridging integrator 2
  ENST ID: ENST00000605423
  CDS Start-End: 1-220
ggcgcggggccagggcggcggcccccagggagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacagtttgtttgtttgttttgagatggagtcttgctctgtcaccgaggctggagtacagtggcgtgatccgatctcagctcactgcagtcttcgcctcccaggttcaagcgatccttctacctcagcctcctgcgtagctgggactacaggcagaaggccacaagctgtacaaggacctgaagaacttccttagtgcagtcaaagtgatgcatgaaagttcaaaaagagtgtcagaaaccctgcaggagatctacagcagcgagtggga

SEQ ID NO: 112143 - DNA, 2003 bp, Homo sapiens
  Payload ID: 1967
  Gene Symbol: BIN2
  Gene Name: bridging integrator 2
  ENST ID: ENST00000604560
  CDS Start-End: 1-1609
gggagttggcaggatggcagagggcaaggcaggcggcgcggccggcctcttcgccaagcaggtgcagaagaagtttagcagggcccaggagaaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatggaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgacta

SEQ ID NO: 112144 - DNA, 2255 bp, Homo sapiens
  Payload ID: 1967
  Gene Symbol: BIN2
  Gene Name: bridging integrator 2
  ENST ID: ENST00000615107
  CDS Start-End: 1-1794
atgcgaggcatgccgggagcccgcacttcctcctcgggggcctcagaaaaccacagggcgcggggccagggcggcggcccccagggagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatggaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctaactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgacta

SEQ ID NO: 112145 - DNA, 1835 bp, Homo sapiens
  Payload ID: 1968
  Gene Symbol: BIN3
  Gene Name: bridging integrator 3
  Uniprot ID: Q9NQY0
  ENST ID: ENST00000276416
  CDS Start-End: 70-831
aatccggaagtgaccctagagaaacgagttgtggctgaggaccccggcggcagacgcaggttcgggaccatgagctggattccttttaagattgggcagcccaagaaacagattgtgcccaaaacagtggagagagactttgaaagggagtatggaaaacttcagcagctggaagagcagacccggaggctgcagaaagacatgaagaagagcaccgacgcagacctggccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccctctggcccctcgttgccttttcacttcaaaacctcttttttctgggagaggccctgaaccctgtgcgggagagctggtcctccagccctggcaggccctcagccagcttcccagcaagacaaagggcacccttgtggctttgggacctaagtggttggggttcccgaggtcactgaggactggtacctcgggaacgcaagctgtcagtggaactgtcccacaagaattcacaggtctcaaagcaggaacagtgggtttgtgtctcacctgagtatctggaattttattttttcaagtaaaattttcaatgaaacgtccacatagtattgtgctgtaacttaggcgagcagaggaaaccccttcctgggcctgctgccctccacggagcagcagcaccctccagcaggcagcccagcatgccaggggtgtgtgcgcacctccccggccctggcccaccttctggagcgaactgcaccgtggtccagcagaggcgctgggtgggagggcacgcgggcaagcctaggagagtaggaagagctgtggaggacacactctcagtttgtttttgactttggtttatttaaaaaacaagccaaaaaaaaaaaaaaaaaa

SEQ ID NO: 112146 - DNA, 1340 bp, Homo sapiens
  Payload ID: 1968
  Gene Symbol: BIN3
  Gene Name: bridging integrator 3
  ENST ID: ENST00000399977
  CDS Start-End: 76-693
ggattccttttaagattgggcagcccaagaaacagattgtgcccaaaacagtggagagagactttgaaagggagtatggaaaacttcagcaccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccctctggcccctcgttgccttttcacttcaaaacctcttttttctgggagaggccctgaaccctgtgcgggagagctggtcctccagccctggcaggccctcagccagcttcccagcaagacaaagggcacccttgtggctttgggacctaagtggttggggttcccgaggtcactgaggactggtacctcgggaacgcaagctgtcagtggaactgtcccacaagaattcacaggtctcaaagcaggaacagtggg

SEQ ID NO: 112147 - DNA, 321 bp, Homo sapiens
  Payload ID: 1968
  Gene Symbol: BIN3
  Gene Name: bridging integrator 3
  ENST ID: ENST00000522268
  CDS Start-End: 98-181
gcttacgtcacttcctggagactggttgaatccggaagtgaccctagagaaacgagttgtggctgaggaccccggcggcagacgcaggttcgggaccatgagctggattccttttaagattgggcagcccaagaaacagattgtgcccaaaacagtgagtaactcgattgttttgctgtgagattcagttctgtatcacatggcctttgcataagaatcaaagctttgaatcaacacatcttggggctgggaagacagcaacctgggccttcttcctgcttatgcggatctagaacctcacatagactgaggcttagaggg

SEQ ID NO: 112148 - DNA, 775 bp, Homo sapiens
  Payload ID: 1968
  Gene Symbol: BIN3
  Gene Name: bridging integrator 3
  ENST ID: ENST00000520292
  CDS Start-End: 72-521
tgaatccggaagtgaccctagagaaacgagttgtggctgaggaccccggcggcagacgcaggttcgggaccatgagctggattccttttaagattgggcagcccaagaaacagattgtgcccaaaacagtggagagagactttgaaagggagtatggaaaacttcagcagctggaagagcagacccggaggctgcagaaagacatgaagaagagcaccgacgcagacctggccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagaggaaccaactcttctggtcctgggtcacctccgaatggccacagagtcatgagctccctgggctgcgcagcctgatcctggacactgcagggctctggcttgcctggtagacgccccctgccattgcaccgagggccagccctccagcagcagcagcgagagcctcaggagagcactgctcctggtcactagaggacacatgatccacaaagacgaggccggtgtggacctgcagcgttgcatcgtccactgctgctctctctgagggccactcctctgagtctcccacgcggtcccttctagtcacagtggaggtcctcagggcattttcctgaagcagctggttggaactttggcggttcca

SEQ ID NO: 112149 - DNA, 1431 bp, Homo sapiens
  Payload ID: 1968
  Gene Symbol: BIN3
  Gene Name: bridging integrator 3
  Uniprot ID: Q9NQY0
  ENST ID: ENST00000519513
  CDS Start-End: 122-721
aagtgaccctagagaaacgagttgtggctgaggaccccggcggcagacgcaggttcgggaccatgagctggattccttttaagattgggcagcccaagaaacagattgtgcccaaaacaccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccctctggcccctcgttgccttttcacttcaaaacctcttttttctgggagaggccctgaaccctgtgcgggagagctggtcctccagccctggcaggccctcagccagcttcccagcaagacaaagggcacccttgtggctttgggacctaagtggttggggttcccgaggtcactgaggactggtacctcgggaacgcaagctgtcagtggaactgtcccacaagaattcacaggtctcaaagcaggaacagtgggtttgtgtctcacctgagtatctggaattttattttttcaagtaaaattttcaatgaaacgtcc

SEQ ID NO: 112150 - DNA, 659 bp, Homo sapiens
  Payload ID: 1968
  Gene Symbol: BIN3
  Gene Name: bridging integrator 3
  ENST ID: ENST00000522687
  CDS Start-End: 75-266
ggttgaatccggaagtgaccctagagaaacgagttgtggctgaggaccccggcggcagacgcaggttcgggaccatgagctggattccttttaagattgggcagcccaagaaacagattgtgcccaaaacagtggagagagactttgaaagggagtatggaaaacttcagcagctggaagagcagacccggaggctgcagaaagacatgaagaagagcaccgacgcagacctggctcctaagcctcagccagttactgatgtgtaaacacacctttcctacaaagcactgatcacaaaaggaaagcgttccttccctgggagccgccgtcaccaccaccatgcccggccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagc

SEQ ID NO: 112151 - DNA, 1472 bp, Homo sapiens
  Payload ID: 1969
  Gene Symbol: BABAM1
  Gene Name: BRISC and BRCA1 A complex member 1
  Uniprot ID: Q9NWV8
  ENST ID: ENST00000359435
  CDS Start-End: 194-1183
tctgcttgttctgcagcccgctgaactacatttcccaggaggcgtcggggctgcgccgtacaacttccggctgtaaagatggcggcttcctagtgagtcggcggctgatttagaaggaggttcaggctacggtgagccgaaggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaa

SEQ ID NO: 112152 - DNA, 930 bp, Homo sapiens
  Payload ID: 1969
  Gene Symbol: BABAM1
  Gene Name: BRISC and BRCA1 A complex member 1
  ENST ID: ENST00000447614
  CDS Start-End: 166-930
agtttctgtctctgcttgttctgcagcccgctgaactacatttcccaggaggcgtcggggctgcgccgtacaacttccggctgtaaagatggcggcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctga

SEQ ID NO: 112153 - DNA, 966 bp, Homo sapiens
  Payload ID: 1969
  Gene Symbol: BABAM1
  Gene Name: BRISC and BRCA1 A complex member 1
  ENST ID: ENST00000595632
  CDS Start-End: 78-842
gaggttcaggctacggtgagccgaaggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttg

SEQ ID NO: 112154 - DNA, 1004 bp, Homo sapiens
  Payload ID: 1969
  Gene Symbol: BABAM1
  Gene Name: BRISC and BRCA1 A complex member 1
  ENST ID: ENST00000594247
  CDS Start-End: 166-492
agtttctgtctctgcttgttctgcagcccgctgaactacatttcccaggaggcgtcggggctgcgccgtacaacttccggctgtaaagatggcggcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggctggagtgtagtggcatgatctcggctcactgcaacctctgcctcccgggttcaagcaattctcctgtgtcagcctcccgagtagctggggttacaggctggagtgcagtg

SEQ ID NO: 112155 - DNA, 534 bp, Homo sapiens
  Payload ID: 1969
  Gene Symbol: BABAM1
  Gene Name: BRISC and BRCA1 A complex member 1
  ENST ID: ENST00000598567
  CDS Start-End: 1-293
acacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaacc

SEQ ID NO: 112156 - DNA, 690 bp, Homo sapiens
  Payload ID: 1969
  Gene Symbol: BABAM1
  Gene Name: BRISC and BRCA1 A complex member 1
  ENST ID: ENST00000601232
  CDS Start-End: 1-99
cccctgcagaaaatgttccagtgcccatatttcttctttgacgttgtttacatccacaatggcactgaggagaaggaggaggagatgagttggaagtagagacggggtttcaccatgttggccagactggtcttgaactcctgatctcaggtgatctgcctgcttcagcctcccaaagcgctgggattacaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaaccgaa

SEQ ID NO: 112157 - DNA, 1366 bp, Homo sapiens
  Payload ID: 1969
  Gene Symbol: BABAM1
  Gene Name: BRISC and BRCA1 A complex member 1
  Uniprot ID: Q9NWV8
  ENST ID: ENST00000601043
  CDS Start-End: 88-1077
gtacaacttccggctgtaaagatggcggcttcctagtgagtcggcggctgatttagaaggaggttcaggctacgccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaa

SEQ ID NO: 112158 - DNA, 799 bp, Homo sapiens
  Payload ID: 1969
  Gene Symbol: BABAM1
  Gene Name: BRISC and BRCA1 A complex member 1
  ENST ID: ENST00000602066
  CDS Start-End: 123-799
tcccaaagtgctgggattacaggcatgagccaccgtgcccgaccgtaaccaaatgtttttaaaactccaaggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagtt

SEQ ID NO: 112159 - DNA, 1470 bp, Homo sapiens
  Payload ID: 1969
  Gene Symbol: BABAM1
  Gene Name: BRISC and BRCA1 A complex member 1
  Uniprot ID: Q9NWV8
  ENST ID: ENST00000598188
  CDS Start-End: 192-1181
tttccaagttctttctagcctcaaccagtttctgtctctgcttgttctgcagcccgctgaactacatttcccaggaggcgtcggggctgcgccgtacaacttccggctgtaaagatggcggcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccatatgtggtccgcaccatccttgtctacagccgtccaccttgccagccccagttctccttgacggagcccatgaagaaaatgttccagtgcccatatttcttctttgacgttgtttacatccacaatggcactgaggagaaggaggaggagatgagttggaaggatatgtttgccttcatgggcagcctggataccaagggtaccagctacaagtatgaggtggcactggctgggccagccctggagttgcacaactgcatggcgaaactgttggcccaccccctgcagcggccttgccagagccatgcttcctacagcctgctggaggaggaggatgaagccattgaggttgaggccactgtctgaaccatccctgtacatctgcaccttcttgtgcaaggaagtccttggcctaaagccttggttctcaaactgggttccttgggacctccggggtgggggggttccaggaggcacgtagggtaccttgcagggtcctaggagggaaacccaggattccaggagggatcccaggaactgtgggcacccattttctgtgtctcccagcccatttccactcctagtttgtcatggataatttttgttcttccctgtgtgatttttgccatcaaaataaaaatttgagactcgttaa

SEQ ID NO: 112160 - DNA, 725 bp, Homo sapiens
  Payload ID: 1969
  Gene Symbol: BABAM1
  Gene Name: BRISC and BRCA1 A complex member 1
  ENST ID: ENST00000596335
  CDS Start-End: 71-725
cttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaccttctccttagcacccccaccagatctggaaggacttttcagcctcatccagcagaaaactgagcttccggtcacagagaacgtgcagacgattcccccgccatatgtgg

SEQ ID NO: 112161 - DNA, 648 bp, Homo sapiens
  Payload ID: 1969
  Gene Symbol: BABAM1
  Gene Name: BRISC and BRCA1 A complex member 1
  ENST ID: ENST00000601436
  CDS Start-End: 68-648
cctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcacacccccaccagatctggaaggacttttcagcctcat

SEQ ID NO: 112162 - DNA, 782 bp, Homo sapiens
  Payload ID: 1969
  Gene Symbol: BABAM1
  Gene Name: BRISC and BRCA1 A complex member 1
  ENST ID: ENST00000601938
  CDS Start-End: 71-782
agctgggattatccgcatgcgccaccacgcccggctaattttgtatttttagttgagacggggtttctccatgttggtcaggctggtctcgaacttccaacctcaggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagagaacgtgcagacgattcccccgccat

SEQ ID NO: 112163 - DNA, 731 bp, Homo sapiens
  Payload ID: 1969
  Gene Symbol: BABAM1
  Gene Name: BRISC and BRCA1 A complex member 1
  ENST ID: ENST00000599474
  CDS Start-End: 132-731
tgcgccgtacaacttccggctgtaaagatggcggcttcctagtgagtcggcggctgatttagaaggaggttcaggctacggggaggattctggcttcccctgtccgtgttccatctagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttcaatctggaaggacttttcagcctcatccagcagaaaactgagcttccggtcacagag

SEQ ID NO: 112164 - DNA, 634 bp, Homo sapiens
  Payload ID: 1969
  Gene Symbol: BABAM1
  Gene Name: BRISC and BRCA1 A complex member 1
  ENST ID: ENST00000599057
  CDS Start-End: 91-634
gtacaacttccggctgtaaagatggcggcttcctagtgagtcggcggctgatttagaaggaggttcaggctacggtgagccgaaggagccatggaagtggcagagcccagcagccccactgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcaggagccggccctaagtcctggcaggtgcccccgccagcccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcctgttccaccttca

SEQ ID NO: 112165 - DNA, 513 bp, Homo sapiens
  Payload ID: 1969
  Gene Symbol: BABAM1
  Gene Name: BRISC and BRCA1 A complex member 1
  ENST ID: ENST00000601171
  CDS Start-End: 85-267
tgtaaagatggcggcttcctagtgagtcggcggctgatttagaaggaggttcaggctacggtgagccgaagccacacaggagccatggaagtggcagagcccagcagccccactgaagaggaggaggaggaagaggagcactcggcagagcctcggccccgcactcgctccaatcctgaaggggctgaggaccgggcagtaggggcacaggccagccccctgaggtccaaattcggacaccaagggtcaactgtccagagaaagtgattatctgcctggacctgtcagaggaaatgtcactgccaaagctggagtcgttcaacggctccaaaaccaacgccctcaatgtctcccagaagatgattgagatgttcgtgcggacaaaacacaagatcgacaaaagccacgagtttgcactggtggtggtgaacgatgacacggcctggctgtctggcctgacctccgacccccgcgagctctgtagctgcctctatgatctggagacggcctcct

SEQ ID NO: 112166 - DNA, 4124 bp, Homo sapiens
  Payload ID: 1970
  Gene Symbol: BROX
  Gene Name: BRO1 domain and CAAX motif containing
  Uniprot ID: Q5VW32
  ENST ID: ENST00000340934
  CDS Start-End: 407-1642
gaggccgccccactgcgccgagggccgccatcgctattgcggcattctccctcggctccggaggtaggggcaactcttctcttcctgtctgggaaaaagaccatagctcaaaaggaaggccgagggagaagttagaaagggatgatgaacgaagcgttttgaggggactgcaacgccgcggcaatacccgcccctgagctgcgcgcactaccgcctcggtagctatcatggccgccgggtcacgtgactccggcttggcgccgtcctggttttccgtcaccctggttctgtagtctcggttctccgactccctctttttctcgcttgtggactccgatatattgcccttcttcccttagaagaactgctgaaccgactctgagaaatttgaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtgcccagcaggatgctgtttttgaattaatttccatgggatttaatgtagctttatggtataccaaatatgcttcaagactggctggaaaagaaaatataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagaaaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactattatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtggtttcaggtatgtttttcttttttctttttcttttttttttttctttttttttttttttttttttgaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatgttttttgaaatgttggaaattttggggaattatcaaatgtatagaagttgcatgaaggttatagagaggtgtaactgtttgttaactattacatggatttcatactaggcagtgacaactaacatgttacttcaactaaaagtgtataatgggttgtctttttatttatgaaaataaaagtaattttacttacaatttcattga

SEQ ID NO: 112167 - DNA, 709 bp, Homo sapiens
  Payload ID: 1970
  Gene Symbol: BROX
  Gene Name: BRO1 domain and CAAX motif containing
  ENST ID: ENST00000426638
  CDS Start-End: 65-709
gggtggtaaacaggaagtgggcgctcagagctcgggggcggcgctcagaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtgcccagcaggatgctgtttttgaattaatttccatgggatttaatgtagctttatggtataccaaatatgcttcaagactggctggaaaagaaaatataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaa

SEQ ID NO: 112168 - DNA, 3670 bp, Homo sapiens
  Payload ID: 1970
  Gene Symbol: BROX
  Gene Name: BRO1 domain and CAAX motif containing
  ENST ID: ENST00000537020
  CDS Start-End: 113-1129
gtcgccgcccgctgcctcgaacgggactgggcacgggaggaagaggctgggtggtaaacaggaagtgggcgctcagagctcgggggcggcgctcagaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtgcccagcaggatgctgtttttgaattaatttccatgggatttaatgtagctttatggtataccaaatatgcttcaagactggctggaaaagaaaatataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagaaaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactattatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtggtttcaggtatgtttttcttttttctttttcttttttttttttctttttttttttttttttttttgaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatgttttttgaaatgttggaaattttggggaattatcaaatgtatagaagttgcatgaaggttatagagaggtgtaactgtttgttaactattacatggatttcatactaggcagtgacaactaacatgttacttcaactaaaagtgtataatgggttgtctttttatttatgaaaataaaagtaattttacttacaatttcattga

SEQ ID NO: 112169 - DNA, 3734 bp, Homo sapiens
  Payload ID: 1970
  Gene Symbol: BROX
  Gene Name: BRO1 domain and CAAX motif containing
  Uniprot ID: Q5VW32
  ENST ID: ENST00000539697
  CDS Start-End: 113-1252
gtcgccgcccgctgcctcgaacgggactgggcacgggaggaagaggctgggtggtaaacaggaagtgggcgctcagagctcgggggcggcgctcagaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagaaaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactattatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtggtttcaggtatgtttttcttttttctttttcttttttttttttctttttttttttttttttttttgaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatgttttttgaaatgttggaaattttggggaattatcaaatgtatagaagttgcatgaaggttatagagaggtgtaactgtttgttaactattacatggatttcatactaggcagtgacaactaacatgttacttcaactaaaagtgtataatgggttgtctttttatttatgaaaataaaagtaattttacttacaatttcattga

SEQ ID NO: 112170 - DNA, 4028 bp, Homo sapiens
  Payload ID: 1970
  Gene Symbol: BROX
  Gene Name: BRO1 domain and CAAX motif containing
  Uniprot ID: Q5VW32
  ENST ID: ENST00000612948
  CDS Start-End: 407-1546
gaggccgccccactgcgccgagggccgccatcgctattgcggcattctccctcggctccggaggtaggggcaactcttctcttcctgtctgggaaaaagaccatagctcaaaaggaaggccgagggagaagttagaaagggatgatgaacgaagcgttttgaggggactgcaacgccgcggcaatacccgcccctgagctgcgcgcactaccgcctcggtagctatcatggccgccgggtcacgtgactccggcttggcgccgtcctggttttccgtcaccctggttctgtagtctcggttctccgactccctctttttctcgcttgtggactccgatatattgcccttcttcccttagaagaactgctgaaccgactctgagaaatttgaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagaaaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaattccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacagaatttcagttcttatttctcaaaatgatttctctgaagcttgtagaataactattatattcagagggttatctgccttcagcttacttgttcttaatttttaatacagcggagatgtttcttgctttgttttcagactctcctttttaatcaggacaacatttgaaagattttattgtgcctctaaagggtatatttgggggttgggtctttttgttaaactctggatagtaataagtttcaggtcagtataggcccgaatcatgtggtttcaggtatgtttttcttttttctttttcttttttttttttctttttttttttttttttttttgaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatgttttttgaaatgttggaaattttggggaattatcaaatgtatagaagttgcatgaaggttatagagaggtgtaactgtttgttaactattacatggatttcatactaggcagtgacaactaacatgttacttcaactaaaagtgtataatgggttgtctttttatttatgaaaataaaagtaattttacttacaatttcattga

SEQ ID NO: 112171 - DNA, 4526 bp, Homo sapiens
  Payload ID: 1971
  Gene Symbol: BAHD1
  Gene Name: bromo adjacent homology domain containing 1
  Uniprot ID: Q8TBE0
  ENST ID: ENST00000416165
  CDS Start-End: 72-2414
cagcccggccggggcctgcgggcgcccagagccgcgccgtccgcgccgcccgttctggttggaagtactccatgacacacactcggagaaagtcccttcccatgctgagttcgggcctcactggccgccgagagcccctgcagatggaagacagcaacatggagcagggggttgagggtgtggagccaggcatgcccgagagcccaggtcacctcacagggcgccgcaagaattacccacttcgtaagcgcccattggttcctgagaagcccaaggcctgcaaagtgctgctgactcgcctggagaatgtggccggtccccggagtgcagatgaggctgatgagctaccgcctgacctgcccaagccccccagcccggccccatccagtgaagaccctggccttgcccagccccgcaagcggcgcctggcctccctcaatgctgaagctctcaataacctgctgctggagcgagaggacaccagcagcctggcaggcacccgccgcagtcgagcaggggatccccaccgcagccgtgaccgtgatcgtgctactgggggctggtcctcctccaagaagcggccccggctgggggaccttggaggaggaagtcgggacctgtctccagagccagcacccgatgaaggtccccgccgagatggagacccagctcccaagagactggctagcctgaacgcagctgctttcctaaaactgagccaggagcgggagctacccctgcggctgcctcgtgcccatgcagaagtagatgggcgctccactgagcccccagcacccaaggccccgaggccaaagtggcccaaggtcaatggcaagaactatcccaaggcttggcagggggccagctctggggaggctgcaggcccacctggctggcaaggctgccctgatgaaccatggccatctgcaactccttgtgggccatccgtccagccatctcatcagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcagaaggctgcagatccctgggccagttggaatttcctctcccggaagctggccacccagcctcacccgcccacccactcctggggtgccctgtacccagtgtgccacctgcagcagagcccgtcccccatcttcagacacccacctcggagccccagacagtagcccgtgcgtgccctcagagcgccaaacctcccagcggttctaagtcaggtctgcgcacaggctccagctgcaggcacactgcaaggagcaaggctgcccgcaggcctagccaccccaagcagccacgtgtccagcgcccacgccctcgccgccgccgtcgccgccgcactaatggctgggtacctgttggggctgcgtgtgagaaggctgtgtatgtcttggatgagccggagccagccatccgaaagagctaccaggcggtagagcggcatggggagacaatccgagtccgggacaccgtccttctcaaatcaggcccacgaaagacctccacaccttatgtggccaagatctctgccctctgggagaaccccgagtcaggagagctgatgatgagcctcctgtggtattacagacctgagcacttacagggaggccgcagtcccagcatgcacgagcccttgcagaatgaagtgtttgcatcgcgacatcaggaccagaacagtgtggcctgcattgaggagaagtgctatgtgctgacttttgccgagtactgcaggttctgtgccatggccaagcgccgaggtgaaggcctccccagccgaaagacagcactggttcccccctctgcagactattccaccccaccccaccgcacagtgccagaggacacggaccctgagctggtgttcctttgccgccatgtctatgacttccgccacgggcgcatccttaagaacccccagtagcctcctcatgcccatgctggggctacccatgggcaagtggggctcggggtagggggcactgcttgaagcacagcacttggttagggggccacagaggcctaagtttgctggcctgtggttttcttgggggggagggcaggggcccctgtgggttctgggctccaggggagggagctggggaggccagggtataagaaaagcatcagaactctcagcttggcccaaggtaccttctgtggttcccctgggtggagatttccgaaaagtagtcttctctgaggctgggccaagcctgagggaaatggggccctaggagggtgggggcgggaaggaggggcaaggtctttcaggaaccagacccaacaggcccttctgtagcctcccccttgccctcaaagggggagtgggggccagctttacctcacccactgtgacccgccgcttccccttcagcctgggaccaggctttcctagatcccagcacagctctgagcttgttcctttgaggcatagagagccagagtctggcttccagagcattgacttcctcttcctagacttgaggccttttctctggctttcctcctttgccctgcagtagcaactggtgctgggacaagttgacccacctctcacagtcatgggtgtggcccacttgtgggagtctcctgtccacctcccagagacggccacccagcgggtctggcttcccagaaagttaactgatgattgtggggtttgtcatatctgggagggaagatgggtgctgggagagggttgggggcagggggcaaggaaaattgctacctgatttgttgaagatttttcctcttgccttacacatggaggttccaggaaacctcttgcagaacttcacacgtgattcttcaagccacacccacctgaaatcaaaccaaaggagtgctgtggctccccttgccctgccaccctttccctagtcttttgtagattgcactaatttacatcctagcaagaatcaacactgtatcagtccacggacctgctgagctgcagccacttgctctaggagctaaggacttgcattttcagtttgttcctgttgcccagaggccctgttctcacctcatgctgctccccagagtagactaacaggctcagtcccctgttgtccttgtggagactaggccttggccctggccctgagactctgtgagggggctggagcagcctggttatttcctatctgtaccaaagaggagtatggtgggagagggagtggagtgcagtgtggcttgggcctggtgctgggaacctgctagctgagcacttccacaagggcatacccctgggggcaggggctggggctgagaactgcagccctgggtcttcccttagggaggaagggcagatgaacccagcaggcttaggaggtggcactgggtgaggacagctgggcaggggctgcagagggaggtggaaatgaaccctgagggctcccccaacttgccatgccctgtcccttagtagatgagttgctcctgattggtcattgggtttgggtgaggcctggaggcttcagaggtgaatttatgcttgggaagcctgatcccaaacctgaagggaagggacttggatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttgacagagattagaagtacttctttaagaaaaaaataaatttgagaaattgtattgatttagaaaaggatcgttt

SEQ ID NO: 112172 - DNA, 4432 bp, Homo sapiens
  Payload ID: 1971
  Gene Symbol: BAHD1
  Gene Name: bromo adjacent homology domain containing 1
  Uniprot ID: Q8TBE0
  ENST ID: ENST00000560846
  CDS Start-End: 1-2334
atgacacacactcggagaaagtcccttcccatgctgagttcgggcctcactggccgccgagagcccctgcagatggaagacagcaacatggagcagggggttgagggtgtggagccaggcatgcccgagagcccaggtcacctcacagggcgccgcaagaattacccacttcgtaagcgcccattggttcctgagaagcccaaggcctgcaaagtgctgctgactcgcctggagaatgtggccggtccccggagtgcagatgaggctgatgagctaccgcctgacctgcccaagccccccagcccggccccatccagtgaagaccctggccttgcccagccccgcaagcggcgcctggcctccctcaatgctgaagctctcaataacctgctgctggagcgagaggacaccagcagcctggcaggcacccgccgcagtcgagcaggggatccccaccgcagccgtgaccgtgatcgtgctactgggggctggtcctcctccaagaagcggccccggctgggggaccttggaggaggaagtcgggacctgtctccagagccagcacccgatgaaggtccccgccgagatggagacccagctcccaagagactggctagcctgaacgcagctgctttcctaaaactgagccaggagcgggagctacccctgcggctgcctcgtgcccatgcagaagtagatgggcgctccactgagcccccagcacccaaggccccgaggccaaagtggcccaaggtcaatggcaagaactatcccaaggcttggcagggggccagctctggggaggctgcaggcccacctggctggcaaggctgccctgatgaaccatggccatctgcaactccttgtgggccatccgtccagccatctcatcagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcagaaggctgcagatccctgggccagttggaatttcctctcccggaagctggccacccagcctcacccgcccacccactcctggggtgccctgtacccagtgtgccacctgcagcagagcccgtcccccatcttcagacacccacctcggagccccagacagtagcccgtgcgtgccctcagagcgccaaacctcccagcggttctaagtcaggtctgcgcacaggctccagctgcaggcacactgcaaggagcaaggctgcccgcaggcctagccaccccaagcagccacgtgtccagcgcccacgccctcgccgccgccgtcgccgccgcactaatggctgggtacctgttggggctgcgtgtgagaaggctgtgtatgtcttggatgagccggagccagccatccgaaagagctaccaggcggtagagcggcatggggagacaatccgagtccgggacaccgtccttctcaaatcaggcccacgaaagacctccacaccttatgtggccaagatctctgccctctgggagaaccccgagtcaggagagctgatgatgagcctcctgtggtattacagacctgagcacttacagggaggccgcagtcccagcatgcacgagaatgaagtgtttgcatcgcgacatcaggaccagaacagtgtggcctgcattgaggagaagtgctatgtgctgacttttgccgagtactgcaggttctgtgccatggccaagcgccgaggtgaaggcctccccagccgaaagacagcactggttcccccctctgcagactattccaccccaccccaccgcacagtgccagaggacacggaccctgagctggtgttcctttgccgccatgtctatgacttccgccacgggcgcatccttaagaacccccagtagcctcctcatgcccatgctggggctacccatgggcaagtggggctcggggtagggggcactgcttgaagcacagcacttggttagggggccacagaggcctaagtttgctggcctgtggttttcttgggggggagggcaggggcccctgtgggttctgggctccaggggagggagctggggaggccagggtataagaaaagcatcagaactctcagcttggcccaaggtaccttctgtggttcccctgggtggagatttccgaaaagtagtcttctctgaggctgggccaagcctgagggaaatggggccctaggagggtgggggcgggaaggaggggcaaggtctttcaggaaccagacccaacaggcccttctgtagcctcccccttgccctcaaagggggagtgggggccagctttacctcacccactgtgacccgccgcttccccttcagcctgggaccaggctttcctagatcccagcacagctctgagcttgttcctttgaggcatagagagccagagtctggcttccagagcattgacttcctcttcctagacttgaggccttttctctggctttcctcctttgccctgcagtagcaactggtgctgggacaagttgacccacctctcacagtcatgggtgtggcccacttgtgggagtctcctgtccacctcccagagacggccacccagcgggtctggcttcccagaaagttaactgatgattgtggggtttgtcatatctgggagggaagatgggtgctgggagagggttgggggcagggggcaaggaaaattgctacctgatttgttgaagatttttcctcttgccttacacatggaggttccaggaaacctcttgcagaacttcacacgtgattcttcaagccacacccacctgaaatcaaaccaaaggagtgctgtggctccccttgccctgccaccctttccctagtcttttgtagattgcactaatttacatcctagcaagaatcaacactgtatcagtccacggacctgctgagctgcagccacttgctctaggagctaaggacttgcattttcagtttgttcctgttgcccagaggccctgttctcacctcatgctgctccccagagtagactaacaggctcagtcccctgttgtccttgtggagactaggccttggccctggccctgagactctgtgagggggctggagcagcctggttatttcctatctgtaccaaagaggagtatggtgggagagggagtggagtgcagtgtggcttgggcctggtgctgggaacctgctagctgagcacttccacaagggcatacccctgggggcaggggctggggctgagaactgcagccctgggtcttcccttagggaggaagggcagatgaacccagcaggcttaggaggtggcactgggtgaggacagctgggcaggggctgcagagggaggtggaaatgaaccctgagggctcccccaacttgccatgccctgtcccttagtagatgagttgctcctgattggtcattgggtttgggtgaggcctggaggcttcagaggtgaatttatgcttgggaagcctgatcccaaacctgaagggaagggacttggatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttgacagagattagaagtacttctttaagaaaaaaataaatttgagaaattgtattgattta

SEQ ID NO: 112173 - DNA, 4698 bp, Homo sapiens
  Payload ID: 1971
  Gene Symbol: BAHD1
  Gene Name: bromo adjacent homology domain containing 1
  Uniprot ID: Q8TBE0
  ENST ID: ENST00000561234
  CDS Start-End: 260-2599
tttctcgagaacctactgtgtgcatatcccgggcttagtgaagtcctaggcgggctctggcaccaccaggtgcccaagacacagctccttcccgcacctaacagggacttcccatctctctctgtgcccttagcctgctgtgcccacccaccccactgaccccgcgagcgtgctcgggcttgggagggcacgtctgtgggggtgagagacggagccacagcatttggtgactagggggaagccaggttggaagtactccatgacacacactcggagaaagtcccttcccatgctgagttcgggcctcactggccgccgagagcccctgcagatggaagacagcaacatggagcagggggttgagggtgtggagccaggcatgcccgagagcccaggtcacctcacagggcgccgcaagaattacccacttcgtaagcgcccattggttcctgagaagcccaaggcctgcaaagtgctgctgactcgcctggagaatgtggccggtccccggagtgcagatgaggctgatgagctaccgcctgacctgcccaagccccccagcccggccccatccagtgaagaccctggccttgcccagccccgcaagcggcgcctggcctccctcaatgctgaagctctcaataacctgctgctggagcgagaggacaccagcagcctggcaggcacccgccgcagtcgagcaggggatccccaccgcagccgtgaccgtgatcgtgctactgggggctggtcctcctccaagaagcggccccggctgggggaccttggaggaggaagtcgggacctgtctccagagccagcacccgatgaaggtccccgccgagatggagacccagctcccaagagactggctagcctgaacgcagctgctttcctaaaactgagccaggagcgggagctacccctgcggctgcctcgtgcccatgcagaagtagatgggcgctccactgagcccccagcacccaaggccccgaggccaaagtggcccaaggtcaatggcaagaactatcccaaggcttggcagggggccagctctggggaggctgcaggcccacctggctggcaaggctgccctgatgaaccatggccatctgcaactccttgtgggccatccgtccagccatctcatcagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcaggctgcagatccctgggccagttggaatttcctctcccggaagctggccacccagcctcacccgcccacccactcctggggtgccctgtacccagtgtgccacctgcagcagagcccgtcccccatcttcagacacccacctcggagccccagacagtagcccgtgcgtgccctcagagcgccaaacctcccagcggttctaagtcaggtctgcgcacaggctccagctgcaggcacactgcaaggagcaaggctgcccgcaggcctagccaccccaagcagccacgtgtccagcgcccacgccctcgccgccgccgtcgccgccgcactaatggctgggtacctgttggggctgcgtgtgagaaggctgtgtatgtcttggatgagccggagccagccatccgaaagagctaccaggcggtagagcggcatggggagacaatccgagtccgggacaccgtccttctcaaatcaggcccacgaaagacctccacaccttatgtggccaagatctctgccctctgggagaaccccgagtcaggagagctgatgatgagcctcctgtggtattacagacctgagcacttacagggaggccgcagtcccagcatgcacgagcccttgcagaatgaagtgtttgcatcgcgacatcaggaccagaacagtgtggcctgcattgaggagaagtgctatgtgctgacttttgccgagtactgcaggttctgtgccatggccaagcgccgaggtgaaggcctccccagccgaaagacagcactggttcccccctctgcagactattccaccccaccccaccgcacagtgccagaggacacggaccctgagctggtgttcctttgccgccatgtctatgacttccgccacgggcgcatccttaagaacccccagtagcctcctcatgcccatgctggggctacccatgggcaagtggggctcggggtagggggcactgcttgaagcacagcacttggttagggggccacagaggcctaagtttgctggcctgtggttttcttgggggggagggcaggggcccctgtgggttctgggctccaggggagggagctggggaggccagggtataagaaaagcatcagaactctcagcttggcccaaggtaccttctgtggttcccctgggtggagatttccgaaaagtagtcttctctgaggctgggccaagcctgagggaaatggggccctaggagggtgggggcgggaaggaggggcaaggtctttcaggaaccagacccaacaggcccttctgtagcctcccccttgccctcaaagggggagtgggggccagctttacctcacccactgtgacccgccgcttccccttcagcctgggaccaggctttcctagatcccagcacagctctgagcttgttcctttgaggcatagagagccagagtctggcttccagagcattgacttcctcttcctagacttgaggccttttctctggctttcctcctttgccctgcagtagcaactggtgctgggacaagttgacccacctctcacagtcatgggtgtggcccacttgtgggagtctcctgtccacctcccagagacggccacccagcgggtctggcttcccagaaagttaactgatgattgtggggtttgtcatatctgggagggaagatgggtgctgggagagggttgggggcagggggcaaggaaaattgctacctgatttgttgaagatttttcctcttgccttacacatggaggttccaggaaacctcttgcagaacttcacacgtgattcttcaagccacacccacctgaaatcaaaccaaaggagtgctgtggctccccttgccctgccaccctttccctagtcttttgtagattgcactaatttacatcctagcaagaatcaacactgtatcagtccacggacctgctgagctgcagccacttgctctaggagctaaggacttgcattttcagtttgttcctgttgcccagaggccctgttctcacctcatgctgctccccagagtagactaacaggctcagtcccctgttgtccttgtggagactaggccttggccctggccctgagactctgtgagggggctggagcagcctggttatttcctatctgtaccaaagaggagtatggtgggagagggagtggagtgcagtgtggcttgggcctggtgctgggaacctgctagctgagcacttccacaagggcatacccctgggggcaggggctggggctgagaactgcagccctgggtcttcccttagggaggaagggcagatgaacccagcaggcttaggaggtggcactgggtgaggacagctgggcaggggctgcagagggaggtggaaatgaaccctgagggctcccccaacttgccatgccctgtcccttagtagatgagttgctcctgattggtcattgggtttgggtgaggcctggaggcttcagaggtgaatttatgcttgggaagcctgatcccaaacctgaagggaagggacttggatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttgacagagattagaagtacttctttaagaaaaaaataaatttgagaaattgtattgatttag

SEQ ID NO: 112174 - DNA, 5920 bp, Homo sapiens
  Payload ID: 1972
  Gene Symbol: BAZ1A
  Gene Name: bromodomain adjacent to zinc finger domain, 1A
  Uniprot ID: Q9NRL2
  ENST ID: ENST00000358716
  CDS Start-End: 569-5143
cttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaaggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttcaaataa

SEQ ID NO: 112175 - DNA, 6010 bp, Homo sapiens
  Payload ID: 1972
  Gene Symbol: BAZ1A
  Gene Name: bromodomain adjacent to zinc finger domain, 1A
  Uniprot ID: Q9NRL2
  ENST ID: ENST00000360310
  CDS Start-End: 569-5239
cttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttc

SEQ ID NO: 112176 - DNA, 5775 bp, Homo sapiens
  Payload ID: 1972
  Gene Symbol: BAZ1A
  Gene Name: bromodomain adjacent to zinc finger domain, 1A
  Uniprot ID: Q9NRL2
  ENST ID: ENST00000382422
  CDS Start-End: 329-4999
cccgcactgccccccgcggcggggcgtcctgccccattgtgaggcggcggcaggacgagaggaggtagggcgcgctcggggggcaggggcggcggcggctccgctcgctcgacacccgggcagcggcaggaacgaactcggctccggtagcggccgcggcgcgtcagtcacacaaaaggcagccgagcttctcccagcgcgcggaccggcccacgctgccgccgagggctccccaccttaccggctttcctttccctccaattttgatagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttcaaata

SEQ ID NO: 112177 - DNA, 579 bp, Homo sapiens
  Payload ID: 1972
  Gene Symbol: BAZ1A
  Gene Name: bromodomain adjacent to zinc finger domain, 1A
  ENST ID: ENST00000555331
  CDS Start-End: 1-37
cagaaaaagacaatctccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtcca

SEQ ID NO: 112178 - DNA, 540 bp, Homo sapiens
  Payload ID: 1972
  Gene Symbol: BAZ1A
  Gene Name: bromodomain adjacent to zinc finger domain, 1A
  ENST ID: ENST00000554865
  CDS Start-End: 1-229
acttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttggtaaaacagaaattaataaggatcaaaagggagatagaaaaaaaaaaggacaagaaaaagagagaggaagatctatctagtgtgagagatgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgtt

SEQ ID NO: 112179 - DNA, 445 bp, Homo sapiens
  Payload ID: 1972
  Gene Symbol: BAZ1A
  Gene Name: bromodomain adjacent to zinc finger domain, 1A
  ENST ID: ENST00000553573
  CDS Start-End: 1-233
catatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggtttcccctgttaacagccaaataatgaagttgatctacaatcacaaattctctggaatctgaactaaattgatagacagtcctgactcagacagtcactagttttccatctgattttagtagccagatgtgccaggtataggaagaaaaaagatgcaattgatcccttactattcaagtataaagtgcaacccactaaaaaagaattacatgagtctgctattgttaaagcaacac

SEQ ID NO: 112180 - DNA, 673 bp, Homo sapiens
  Payload ID: 1972
  Gene Symbol: BAZ1A
  Gene Name: bromodomain adjacent to zinc finger domain, 1A
  ENST ID: ENST00000556314
  CDS Start-End: 1-656
atagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaaggggtaatactgaaatttctttagggcattcttgtgtatttgtttttaaccaataaagcactttattaattca

SEQ ID NO: 112181 - DNA, 6102 bp, Homo sapiens
  Payload ID: 1973
  Gene Symbol: BAZ1B
  Gene Name: bromodomain adjacent to zinc finger domain, 1B
  Uniprot ID: Q9UIG0
  ENST ID: ENST00000339594
  CDS Start-End: 340-4791
cgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaaccactctg

SEQ ID NO: 112182 - DNA, 5428 bp, Homo sapiens
  Payload ID: 1973
  Gene Symbol: BAZ1B
  Gene Name: bromodomain adjacent to zinc finger domain, 1B
  Uniprot ID: Q9UIG0
  ENST ID: ENST00000404251
  CDS Start-End: 346-4797
cgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttct

SEQ ID NO: 112183 - DNA, 8831 bp, Homo sapiens
  Payload ID: 1974
  Gene Symbol: BAZ2A
  Gene Name: bromodomain adjacent to zinc finger domain, 2A
  ENST ID: ENST00000379441
  CDS Start-End: 182-5809
gggacatcaccctacagcagttcaggctgtgtggttcgcaggaagcatacactggctttttgattcttgctagttcccagctcacagtttgggaggatccaacaccaacctttacgtgaagtggaggcccaaggacagtgaggagctgggtggtcccagcctggagctgtgccagcctgacatggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtggatggaaagggtcattagtgctcctgcctaaatgtctggctgagttgctggagcaaagggggattcagtgcatccaggtcctgccttgtgagatgtggccccagcttcctaagctgccacctctgtgttcctgtcatagcaaatatgggaccatcaccagcttaccacttcccactcacggataagacaccaagacgtagac

SEQ ID NO: 112184 - DNA, 8600 bp, Homo sapiens
  Payload ID: 1974
  Gene Symbol: BAZ2A
  Gene Name: bromodomain adjacent to zinc finger domain, 2A
  Uniprot ID: Q9UIF9
  ENST ID: ENST00000551812
  CDS Start-End: 195-5912
agtctgtcacacagggacatcaccctacagcagttcaggctgtgtggttcgcaggaagcatacactggctttttgattcttgctagttcccagctcacagtttgggaggatccaacaccaacctttacgtgaagtggaggcccaaggacagtgaggagctgggtggtcccagcctggagctgtgccagcctgacatggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaaccacatttgatagaga

SEQ ID NO: 112185 - DNA, 577 bp, Homo sapiens
  Payload ID: 1974
  Gene Symbol: BAZ2A
  Gene Name: bromodomain adjacent to zinc finger domain, 2A
  ENST ID: ENST00000549506
  CDS Start-End: 230-577
acactggctttttgattcttgctagttcccagctcacagtttgggaggatccaacaccaacctttacgtgaagtggaggcccaaggacagtgaggagctgggtggtcccagcctggagctgtgccagcctgacatgggaatctttcctttccggtgaccagggccctgcagatgtcgccaggaaagtggtgatccaggcaggaccaggctgcactgaagggacagagaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcgggg

SEQ ID NO: 112186 - DNA, 484 bp, Homo sapiens
  Payload ID: 1974
  Gene Symbol: BAZ2A
  Gene Name: bromodomain adjacent to zinc finger domain, 2A
  ENST ID: ENST00000547453
  CDS Start-End: 1-484
caatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccaagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagaccta

SEQ ID NO: 112187 - DNA, 849 bp, Homo sapiens
  Payload ID: 1974
  Gene Symbol: BAZ2A
  Gene Name: bromodomain adjacent to zinc finger domain, 2A
  ENST ID: ENST00000551996
  CDS Start-End: 1-833
tcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatggggcccatgtgcttctctggcaggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgcca

SEQ ID NO: 112188 - DNA, 6050 bp, Homo sapiens
  Payload ID: 1974
  Gene Symbol: BAZ2A
  Gene Name: bromodomain adjacent to zinc finger domain, 2A
  ENST ID: ENST00000549884
  CDS Start-End: 90-5801
gttctggcgcccggagcgcggccatgtgaaccgcttgtaccccggggagagacgagccccgagcccggctggacgccgctgcctcagaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaag

SEQ ID NO: 112189 - DNA, 2773 bp, Homo sapiens
  Payload ID: 1974
  Gene Symbol: BAZ2A
  Gene Name: bromodomain adjacent to zinc finger domain, 2A
  ENST ID: ENST00000549787
  CDS Start-End: 1-2514
gtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataa

SEQ ID NO: 112190 - DNA, 614 bp, Homo sapiens
  Payload ID: 1974
  Gene Symbol: BAZ2A
  Gene Name: bromodomain adjacent to zinc finger domain, 2A
  ENST ID: ENST00000547650
  CDS Start-End: 1-614
gatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaag

SEQ ID NO: 112191 - DNA, 722 bp, Homo sapiens
  Payload ID: 1974
  Gene Symbol: BAZ2A
  Gene Name: bromodomain adjacent to zinc finger domain, 2A
  ENST ID: ENST00000546695
  CDS Start-End: 328-722
tctcgggccccgcggttgagccgcgtccccctcccccttcccgaaccccggaccccagaccccctccccagcgggcgtctccacccgttctggcgcccggagcgcggccatgtgaaccgcttgtaccccggggagagacgagccccgagcccggctggacgccgctgcctcaggtttgtggggtctgtggccaggggcctgagggggagggagccccgctttcatccgaggcttccctcggggaacagaagctccagagccggcttgagccttgccggggcgggaagccgacgggagcttatttcctgcgaggatccaacccgagaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttc

SEQ ID NO: 112192 - DNA, 631 bp, Homo sapiens
  Payload ID: 1975
  Gene Symbol: BAZ2B
  Gene Name: bromodomain adjacent to zinc finger domain, 2B
  ENST ID: ENST00000294905
  CDS Start-End: 1-631
aatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggagttggagaggcatagactagatatggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatcca

SEQ ID NO: 112193 - DNA, 2364 bp, Homo sapiens
  Payload ID: 1975
  Gene Symbol: BAZ2B
  Gene Name: bromodomain adjacent to zinc finger domain, 2B
  ENST ID: ENST00000343439
  CDS Start-End: 298-2229
ggtacacccacagccttagccgcacatccccaactagcatcttttccagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatgctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccg

SEQ ID NO: 112194 - DNA, 8058 bp, Homo sapiens
  Payload ID: 1975
  Gene Symbol: BAZ2B
  Gene Name: bromodomain adjacent to zinc finger domain, 2B
  Uniprot ID: Q9UIF8
  ENST ID: ENST00000392782
  CDS Start-End: 374-6772
gaagccttgttggttgacgtcacttggttcatgaagccttcgcctagaagtgaagctgctgaacaaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 112195 - DNA, 8289 bp, Homo sapiens
  Payload ID: 1975
  Gene Symbol: BAZ2B
  Gene Name: bromodomain adjacent to zinc finger domain, 2B
  Uniprot ID: Q9UIF8
  ENST ID: ENST00000392783
  CDS Start-End: 497-7003
tcccttggctcctttaggagctgataggtcatttattattggaactgaaatggtataaacaattctctctctttttttcccttgttaacagcaactttcattgttagagagaggagagagagagaagccttgttggttgacgtcacttggttcatgaagccttcgcctagaagtgaagctgctgaacaaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 112196 - DNA, 580 bp, Homo sapiens
  Payload ID: 1975
  Gene Symbol: BAZ2B
  Gene Name: bromodomain adjacent to zinc finger domain, 2B
  ENST ID: ENST00000441143
  CDS Start-End: 1-580
caataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatcc

SEQ ID NO: 112197 - DNA, 537 bp, Homo sapiens
  Payload ID: 1975
  Gene Symbol: BAZ2B
  Gene Name: bromodomain adjacent to zinc finger domain, 2B
  ENST ID: ENST00000426648
  CDS Start-End: 1-537
gtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaaggtatctgaagagccccttaagtaccaccattcagatcaaactggataatgtgggcacagttactgtccctgctcctgcaccatccgttagtggtgatggtgacggaattgaagaggatattgctccagggctcagggtatggagaagggcattatcagaagctcgcagtgctgcacaggtagctctgtgcattcagcaattacagaaatcaatagcatgggaa

SEQ ID NO: 112198 - DNA, 640 bp, Homo sapiens
  Payload ID: 1975
  Gene Symbol: BAZ2B
  Gene Name: bromodomain adjacent to zinc finger domain, 2B
  ENST ID: ENST00000437839
  CDS Start-End: 213-640
ccggcttgggcctctagctctcccgtgtgtagctggaggctctgagtttactgaagatgagcgggggtgggggtggggcaggtgggattgggaaaagatctggatacctgggaaggtctatgtcagcacgcagaaggtttgaggagcattgcttctcatacagtaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtgcagaatggtggcgaacaactgatgctcatactcgtacaggagcaaccttctttccaccattactgggaattccaccactatttgctccccc

SEQ ID NO: 112199 - DNA, 594 bp, Homo sapiens
  Payload ID: 1975
  Gene Symbol: BAZ2B
  Gene Name: bromodomain adjacent to zinc finger domain, 2B
  ENST ID: ENST00000541068
  CDS Start-End: 310-594
aaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcag

SEQ ID NO: 112200 - DNA, 4736 bp, Homo sapiens
  Payload ID: 1976
  Gene Symbol: BRPF1
  Gene Name: bromodomain and PHD finger containing, 1
  Uniprot ID: P55201
  ENST ID: ENST00000383829
  CDS Start-End: 405-4067
gacgccgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggccgtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtaaccgaattggacgaagtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatggacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaattc

SEQ ID NO: 112201 - DNA, 4712 bp, Homo sapiens
  Payload ID: 1976
  Gene Symbol: BRPF1
  Gene Name: bromodomain and PHD finger containing, 1
  Uniprot ID: P55201
  ENST ID: ENST00000424362
  CDS Start-End: 405-4046
gacgccgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggccgtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatggacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaa

SEQ ID NO: 112202 - DNA, 4304 bp, Homo sapiens
  Payload ID: 1976
  Gene Symbol: BRPF1
  Gene Name: bromodomain and PHD finger containing, 1
  Uniprot ID: P55201
  ENST ID: ENST00000433861
  CDS Start-End: 421-3780
acgtttaccctgcgcagacgccgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggccgtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaagacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtact

SEQ ID NO: 112203 - DNA, 534 bp, Homo sapiens
  Payload ID: 1976
  Gene Symbol: BRPF1
  Gene Name: bromodomain and PHD finger containing, 1
  ENST ID: ENST00000426583
  CDS Start-End: 219-534
agatgcagccgccattctccttgggccctccccacgggctttctggtctaagttctcgtctccctcgcctgtgcctctgctgccgggttccaaggggagattgctgattcgctgtgctactttgggaaccattcacccgggacccagcttggaaagaggagagcttgtttgtgcttcggttggtttatgtttaaagacacagccgcagatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggcc

SEQ ID NO: 112204 - DNA, 4308 bp, Homo sapiens
  Payload ID: 1976
  Gene Symbol: BRPF1
  Gene Name: bromodomain and PHD finger containing, 1
  Uniprot ID: P55201
  ENST ID: ENST00000457855
  CDS Start-End: 12-3656
gatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggccgtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatggacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaa

SEQ ID NO: 112205 - DNA, 860 bp, Homo sapiens
  Payload ID: 1976
  Gene Symbol: BRPF1
  Gene Name: bromodomain and PHD finger containing, 1
  ENST ID: ENST00000420291
  CDS Start-End: 560-860
ttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgtacatctcctacccagtaccagggccaggctccccataaagacctcaaaagtaaatgaattctttctgtgatccagtgatttctgcaggagtccaacgctaaagcattagccacccacccattcagctttctacatggccttcatcccatctgagctctcagtctggtgatcccctcattcagctattcgttcaacagatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggagg

SEQ ID NO: 112206 - DNA, 4820 bp, Homo sapiens
  Payload ID: 1977
  Gene Symbol: BRPF3
  Gene Name: bromodomain and PHD finger containing, 3
  Uniprot ID: Q9ULD4
  ENST ID: ENST00000339717
  CDS Start-End: 32-2839
ctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctg

SEQ ID NO: 112207 - DNA, 6052 bp, Homo sapiens
  Payload ID: 1977
  Gene Symbol: BRPF3
  Gene Name: bromodomain and PHD finger containing, 3
  Uniprot ID: Q9ULD4
  ENST ID: ENST00000357641
  CDS Start-End: 254-3871
gtggcggcagcggcagcagcggcggctccattccccctcctcccccgggagcggcggcggcggccgggccggggccccagcgcgggccgggagggggcacggcggaggccacggaggcaggcgcgggagaagaccgcgctccgcttcccgggccgcgccgacctgctcggcggcctgcccgcccgcgcccaggggccccgaacggtggggccgggcaggcggctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggcagta

SEQ ID NO: 112208 - DNA, 414 bp, Homo sapiens
  Payload ID: 1977
  Gene Symbol: BRPF3
  Gene Name: bromodomain and PHD finger containing, 3
  ENST ID: ENST00000446974
  CDS Start-End: 129-414
ggactccacgtcaggctgtctctggtgcgctcgcccctcccctctgaggagatgttatttccctcctttcttctccgaggggtcaagattcttctggaagaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatcca

SEQ ID NO: 112209 - DNA, 5380 bp, Homo sapiens
  Payload ID: 1977
  Gene Symbol: BRPF3
  Gene Name: bromodomain and PHD finger containing, 3
  ENST ID: ENST00000441123
  CDS Start-End: 1-1798
ccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttttatatgtttaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcaggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggcagta

SEQ ID NO: 112210 - DNA, 3329 bp, Homo sapiens
  Payload ID: 1977
  Gene Symbol: BRPF3
  Gene Name: bromodomain and PHD finger containing, 3
  ENST ID: ENST00000441730
  CDS Start-End: 1-739
accatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggca

SEQ ID NO: 112211 - DNA, 582 bp, Homo sapiens
  Payload ID: 1977
  Gene Symbol: BRPF3
  Gene Name: bromodomain and PHD finger containing, 3
  ENST ID: ENST00000454960
  CDS Start-End: 196-582
atttccctcctttcttctccgaggggtcaagattcttctggaagaggtgcccccttaaaggagcaggagccttggctggggtcctccttgtctcctgagtatcttgtgtgaggtgcaggggatacagtctaattgcagaagctcctcattcttcggggacctggatggggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaa

SEQ ID NO: 112212 - DNA, 4816 bp, Homo sapiens
  Payload ID: 1977
  Gene Symbol: BRPF3
  Gene Name: bromodomain and PHD finger containing, 3
  ENST ID: ENST00000449261
  CDS Start-End: 32-2497
ctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctg

SEQ ID NO: 112213 - DNA, 437 bp, Homo sapiens
  Payload ID: 1977
  Gene Symbol: BRPF3
  Gene Name: bromodomain and PHD finger containing, 3
  ENST ID: ENST00000527657
  CDS Start-End: 159-437
ttcttttggaggattaggactgcaaggcaagaggtggaaaagcaaatgaaataactcatgctgaatctgagctgcttaactttactgtccttttcaagcctttctctgaggtgaggtatttggccattttattctgtcttcctgtataaggttcagaaatgaaccaggtctggataggatgcacaggctgtaatctgggctgcccactgaccttgtctttcacttccgtgtgcctctactcaaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggag

SEQ ID NO: 112214 - DNA, 4628 bp, Homo sapiens
  Payload ID: 1977
  Gene Symbol: BRPF3
  Gene Name: bromodomain and PHD finger containing, 3
  Uniprot ID: Q9ULD4
  ENST ID: ENST00000534694
  CDS Start-End: 32-2647
ctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctg

SEQ ID NO: 112215 - DNA, 4254 bp, Homo sapiens
  Payload ID: 1977
  Gene Symbol: BRPF3
  Gene Name: bromodomain and PHD finger containing, 3
  ENST ID: ENST00000534400
  CDS Start-End: 27-3347
gcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcagatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctccccca

SEQ ID NO: 112216 - DNA, 4077 bp, Homo sapiens
  Payload ID: 1977
  Gene Symbol: BRPF3
  Gene Name: bromodomain and PHD finger containing, 3
  ENST ID: ENST00000532330
  CDS Start-End: 27-1907
gcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttttatatgtttaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacagatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctgggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctccccca

SEQ ID NO: 112217 - DNA, 10141 bp, Homo sapiens
  Payload ID: 1978
  Gene Symbol: BRWD1
  Gene Name: bromodomain and WD repeat domain containing 1
  Uniprot ID: Q9NSI6
  ENST ID: ENST00000333229
  CDS Start-End: 329-7291
aggtctttgcctccgcgtcactttctcctcatcgagtccccggaggcagagagctgagcgaggttcgcctccccgggcgggacacgagctccggtcctctcttggcgcaaacccccgccccccgcggagggactacttttcgtctcccgcggaggaactacttcctcccccgcggaggcgtcggtccaggcggcgcgcacggtatggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaaggaggagagtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaatcatcagaaaggaggaaaagaaatagacctataacaaatggttctacattatctgaaagtgaagtggaagattctttagctacctctttgtcatcgtcagcttccagtagttctgaggaaagcaaagagagttccagagctcgtgaatcctcctcacgcagtgggctatccagaagcagcaatctcagggtaaccagaactagagctgctcaaagaaaaactggtcccgtttcattagcaaatggatgtggcagaaaagccactcgaaagagagtctatttaagtgattctgataacaattcattggagactggtgaaattctaaaagccagagctggaaataaccgaaaagtcttaaggaagtgtgctgctgtggctgccaataaaataaagctaatgagtgatgtagaagagaattctagctctgaaagtgtctgttctggtcggaagctgcctcaccgcaatgcttctgctgtagctagaaaaaagttattacataattctgaagatgaacagagcttaaagtcagaaattgaagaagaggagctaaaagatgaaaatcaactattaccagtgtccagttctcacactgcccagagcaatgttgatgaatctgaaaacagagactcagagtcagaaagtgatttgcgggtagcccggaaaaattggcatgctaatggttacaagtcccatactccagcaccttcaaagacaaaatttcttaaaatagagtcttctgaggaagactctaaaagtcatgattcagatcatgcatgtaacagaactgctggcccatcaacgtctgtgcagaaacttaaggcagagagcatctcagaggaagcagattctgaaccaggaagatctggtggtaggaaatacaatacatttcacaagaatgcgagtttctttaaaaaaaccaagattctgagtgactcagaagactctgaatctgaagagcaagatagagaagatgggaaatgtcataaaatggaaatgaacccaatttcaggaaatctgaactgtgaccctattgctatgtcccagtgttcctcagatcatggatgtgaaactgatttagattcagatgatgacaaaatagaaaaaccaaacaattttatgaaagattctgcatcacaagacaatggactaagcagaaaaatttccaggaaaagggtctgttccagtgactcagacagtagtttacaggtggttaagaaatcatcaaaagccagaacaggtctcctgaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaagaatttgttcctagagacagagaacccaatacaaaagtgagaacatgtatgcataatcagaaggatgcagtgcagatgcctagtgaaactctgaaagcaaaaatggtacctgagaaagttccccgcagatgtgctactgttgctgcaaataaaataaagataatgagtaatctaaaagaaacgatctcaggaccagaaaatgtctggattaggaagagtagcagaaaactgccccatcgaaatgcttctgctgcggctaagaaaaaattactgaatgtttataaagaggatgatacaaccataaattctgaaagtgaaaaagagctagaagatattaatagaaaaatgctttttttaagggggttcagatcctggaaagaaaatgcacaatagtgactatgagaatgtagaagtggcatctgaaaacaattggtacacaagtaaactggcagttacattctgctcccagctctaaaattactcccttattggcatctttggaggaattttctaaaagccataatccagtgggttcctcccagtcagctcttgtacagacatgtgctctggggaattctgaggaggaaataaattgcagagtctgtaggtggagaggtggaaagaaaagacaaatggcctgctataagactactattcctttccagaatgcaaggccttgaagacatgattccttagaggaagaatataatgggaagtgtacaggctaggaagaacttgaagtgaacaaatttcaaaatcttaacctgatgctaattttcagggttctccattacagtgtaaaaattcagaccacgacaactatggtgtcatgaggaaaaaaaatcaggcatttttccaaaggaagtgctaatgggcctatttgacttctgagtgaagcaaaaactacccagatccattccctacaattcacatccccaaaggtcaaaaacaaactaggaggacctgggaatttcagctggagatactgattattgagttctgaagtagagtgttggaaataggcaattagagaaagtccattgatgtcattttgtttataatattgcagttcatactgaatgaccacttgatatgactaattcagggaatatatatttttctatgaaagctatgaatgttactatcacggcttttccttatttttacttgtatgtagcagcatttacagaaatgccaaaaatgtgcctcattaagaggcaggtcttaatcagttagataaaaataaaatgtatagcttaagatcaaaacagtcatatttttagatacagtgaaatcttttatgtttctctacagcaccttaaaaattagaacttgaatactttgagtaaacttactacaatctcatcccaacaaactttaatggtagcatgtttggcctatttcattgtggcctgtactaggattagaaaatttggtcgtggtataacaaagaagtgtatttacaataggatttaatttgttgttaatatgtatttgttgaaattaaaattgccagattaaatgaatatactgtcgcatctttttaacatagtaacgtgttactggaaaaattaagttgttgaaagtaagttgttttcccatttaaaaatatctgaatatatgatttgcatgtgtaaatctgaaaaactaaactacagaaacctagggttttctatttcttttttaagtcaaatgcatttttttttttttgttatacagatgaaccaagtgtctaaaatacttgagaaatttgtggttgcatgtctgttttaaaaaaaaggctttttgttttttagcataagccagaatattctaacctactaagtctgtgtcctttgctccttttgtagtatactttcatctaaattactgatccccaatatgttgatacacaggtgagaaagggaagaattcctaataaactgctattacttttaggtgcatggggtttgatttttgagctctaatgaaatgcttaaacttctttccagttcaaattttacacttaatttataatatttattgagtatattatgtcctcaacaagtaactataaaatgaaatacttaactcggtgaagactattttatgcaaagtttttttttttttttttttttttttttagcaatttcagtgtaatgaaagaatttaagctttgaatttataatttgctgtggtggggttaatttctgtcagtatttgagattgtattatcagtcttgcataatgaaatccttttttggctaagtatttaattcgaacatatttgcctttttaaaaagtgcttggcctaaacttattgtaactgcatgaaataagcatttgcttaaaacttaacattgtaaaattgttctctctgaaatgtgtgcagaatttaaatcatggccaaatgtattactattaccctatttacagtaatttgctttgcagaaaatatttcttcatcatggaactgtgaaatcaaattgaagatcttactggtaaaaatgacaaattaacaaaaggactaagacaagtggtgcccaaacaacctttttattctgcagttccatcatcataatagaccagttaacccaggagtcctaatgttttaaaacatcattgtggtgatcttgtttattctatctcactaaggatatccagtttcctaagctcttactggctagcaatttcgtcttaattttattgctaaatgttcaaattttgcttccaaactcactttatttttgcagatgtgtacatctgctaagtactaattttatgtaaatgattttgttgattatctttccacatcttaaaatgtttctaacagctttgagattttatctcaacaggctctctctgaccccaaagtagtacttaccttcgtgactactgacaaagtcacaaaatgcaggcgatgtcatgtatttcggtacaactaaatctaggaaacggttttttcattgcattactgcatattttcattttcatttaaattatgtcccctttttctcttgcttgaaacagtgctcctcgaactttgtcttccagcacattttaaagagaaccaattaaagaacaatcacacattctgcttattaaaggctatttaaaaagaaacattttgtattagaaaatggccaactttaaaacactattttttacactcataaaaatgttttttaaatcgccttgacaatcatcagcttttgaaatgtgaattcctattgccagagtaaaggtctcgtttttataccacca

SEQ ID NO: 112218 - DNA, 2495 bp, Homo sapiens
  Payload ID: 1978
  Gene Symbol: BRWD1
  Gene Name: bromodomain and WD repeat domain containing 1
  Uniprot ID: Q9NSI6
  ENST ID: ENST00000341322
  CDS Start-End: 152-514
gcgtcggtccaggcggcgcgcacggtatggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcattgtggaagaaaggtgataatgtaactataaatcatgctgtggactataaaattctctgcatttagcatagaacattgaattttattacataagtgtttaatgggtccttctgcattaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaactctttaaatgctagaggtatttcatttgatatttagcttctgaaagccctttgttataaagggaagtgattttctaaatttggtagcagcttgaaaacaagcaccacaaatgtaaaactgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctagccatgtcaccctgtggcactaatcaggacactgtttatattcttcctcttctgtgtccctattcactttgtaattattctattttagctggttatatggtagttaattggtagcctgttttcctttgttttctttacttgtgtcaagctccatgtcgttgttttgtgatgagcagtgatttagaactggccagaccttagaagagtcttcagcaagctgccctagggtaggggcgtattctctgtttgttttgtactggtaccccaggaggatgccttgtaactgctctttggtcatgatagtggtaatgaatccattcatgtaaaatgcaatatgtctgttagtttggggcacccgaggctcagtagaggtttagtatgatgccttccctttcttctttgagttatgaagaaactaatttctggcacagtgtgactgcttcaaacctatgttctgctgctatctcctatagaggagggcagacttttttttcttagtgcatttgctggtaggtcaaggagggatggactttgaattagtgttcagagtcacagatcctacgtatgtgctcttcagtagaggattttctgtgatcctacaatgaagggaaagctatataatttattggtacttcctaaagatagagactaaagtcatggtagtattggccaaattaattttaaaactgaacaagtcatgaattttcatataaatcaaagaactttttccttataaaagcttccatttttgaaaagttggatcagttgtaagacctttcatctttagtattgtatgatataattctacattgaaaaataaacacttggcattaaatgggacttggagtcaaaagatctggttttatggtccatcttttaccaatcatttgctgtggatctctttaaaggtcctggaacctttgagcctcagttacctcacttgtaaattggcaaaaatacctacctcacagggttgttgtgaggattcaatgagctaatgtatgttgaaagcactttgtgaattgtaaagtgctacacaaatgttagttgttgttgctgctgtatctgagatgtcttaattttctttttcttcagaaatagtctaataaacctccagggcttttctgttaaagtatactagttggtaaaatgttgaataaacagtttattacaatata

SEQ ID NO: 112219 - DNA, 12929 bp, Homo sapiens
  Payload ID: 1978
  Gene Symbol: BRWD1
  Gene Name: bromodomain and WD repeat domain containing 1
  Uniprot ID: Q9NSI6
  ENST ID: ENST00000342449
  CDS Start-End: 80-6889
cgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaaggaggagagtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaatcatcagaaaggaggaaaagaaatagacctataacaaatggttctacattatctgaaagtgaagtggaagattctttagctacctctttgtcatcgtcagcttccagtagttctgaggaaagcaaagagagttccagagctcgtgaatcctcctcacgcagtgggctatccagaagcagcaatctcagggtaaccagaactagagctgctcaaagaaaaactggtcccgtttcattagcaaatggatgtggcagaaaagccactcgaaagagagtctatttaagtgattctgataacaattcattggagactggtgaaattctaaaagccagagctggaaataaccgaaaagtcttaaggaagtgtgctgctgtggctgccaataaaataaagctaatgagtgatgtagaagagaattctagctctgaaagtgtctgttctggtcggaagctgcctcaccgcaatgcttctgctgtagctagaaaaaagttattacataattctgaagatgaacagagcttaaagtcagaaattgaagaagaggagctaaaagatgaaaatcaactattaccagtgtccagttctcacactgcccagagcaatgttgatgaatctgaaaacagagactcagagtcagaaagtgatttgcgggtagcccggaaaaattggcatgctaatggttacaagtcccatactccagcaccttcaaagacaaaatttcttaaaatagagtcttctgaggaagactctaaaagtcatgattcagatcatgcatgtaacagaactgctggcccatcaacgtctgtgcagaaacttaaggcagagagcatctcagaggaagcagattctgaaccaggaagatctggtggtaggaaatacaatacatttcacaagaatgcgagtttctttaaaaaaaccaagattctgagtgactcagaagactctgaatctgaagagcaagatagagaagatgggaaatgtcataaaatggaaatgaacccaatttcaggaaatctgaactgtgaccctattgctatgtcccagtgttcctcagatcatggatgtgaaactgatttagattcagatgatgacaaaatagaaaaaccaaacaattttatgaaagattctgcatcacaagacaatggactaagcagaaaaatttccaggaaaagggtctgttccagtgactcagacagtagtttacaggtggttaagaaatcatcaaaagccagaacaggtctcctgaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaaggtaaaacttttacagctaacatatctaaaactgtgagacgtcaaagacaaagcaaacgccctaggttaagtgtggatgataatgactgggaggatttggactatgcaaaatctaaaagagttcttcgacgttcaaaaataaaaacgagaaatcagggtagaaggactgtgagataccatgatggggatgatgacagaagtttagaaaatgtgttagatttcaatggttgcaccttatgaccttgagggaaagccagttcatttaagaggaaatggactggcatttatggtgaaagctggctgttaaaattatttttttgtcttacaattcagggaatatatttatatttttctatgaaaagttatgaatgtgactaaatcatgactgttatttttatttgcacttgctggtctttgtagcagcattcagcacaggtgccaaaatatgcttcattttgggggcagatctattttgacagtatttgactacatatagcaagagtttgaaatatgttaaacactagacatcctggttatcaaaaccaatgagcattactttcatggcagcaagtgtcatgcagttattttctgaatttgtcaaagaggcagtagtttctaacccctgttctatagtagttacaacaatttcacaacctatgtttacagattcttcataaatacatgcatactgacactataatcatgggaggtgtaaccatgattagtaggcgaggtacctaccacttttttttttttcttcccctggctacttgagtagaatgcattataccagatctggtcactttcattgaaatggtttctaattttcttcccaagtgctgttgggtttttttcttcttaaggaaaacgttgtcacttttatgttataaacttgaatttataaagtgctggtaaattatttttaatgatttgagtgcatgttttaaacctctaggaccagagcatagtcagagcattttcttttaaattgtgcactaacaaaatgctatataatctgtcttctgtccaagatctcctggtttccattgtaagggatttaaccaaaatcttgctcttccataatcttactctgtgaaatagaggaattcgtgtgccttagatttagaagtgtgttctttaatagagtgtacagggctaaaagagtatttaagttaatatgtaggtttcccccatctgtattccaattgtagaggtgagttttgttaagagtacaattgcaaatcttatctatataggaaaatagctaaatgtcattctccatctctttgttttagtttactgcttccatgtgcaatcctaagcattctttgctggggcaactaaatgtatctttattagtgacttctagtccaaatataagaaactgtcatgttttgtgggaaaataattttataatccatttaaagtgaaagtttatcacacaaatagtacacttattttctaaccaaatacttgataggttatgctactccagtgtagatggccattcctaacttgtttgtgcctgaagatggacttgattcaaatggtttacatatttagtgggtaagggatatgttacagtaccccacctgtaagttatttattagccctaattgtgtttgatttcagacaaaattaacccttttctcctgtgtatctttgaagtggcagataaggtgaagcatcagactggtatcaatattagacaatgttatttattagccctaattgtgtttggtttcagacaaaaccttttctcctgtgtatctttgaagtggcagacaaggcgaagcatcagactggtattaatgttagagaatgttctgaagtgttcctattttgtagttatctattccatttgacatagtagaaggtacattttctttctactctgatgcatggggaaggatgtttttggacattatcaactgagataggtgggaaacctcctctcatttgtggcttagagagctatcaccatttcagaactatgatgcttttcttctcagaacttgtgttaagtagatagtaaacagattgattcatgataattgtccttgactaagactgaaaagactaatgggatgccttttactttgctaattttaaaaactggtgatagatgtcaaatccattaatttatttaaactcttcttaaccttctcttttataatctgttctcaggttttaactccatgtttaccatcatttgcaaaaaggtaccaaaaaaatccataaataaatatggaatacattcataagtacatacattcttttggtataaaacaatattttgacagtttaggcttcattaatagaactattctgattatttggactgcattaattggtcattgactggccatccaattaccattttttctttcagtccaaaatagttagacccttgcatacagaagtggtattttggtttttaatcagatttggtttcatcagaagcagcaagaatggacctgatgtctttaaaagcatagccgacaatggtagcttctcaagttatgaaataaaactgagagataatggagaaaataatttttatgggtttttttggttatggtgctattcctaaggttaactttgaatatgtgacacacacactcctaagtacctttaaggaaaattaataaatcattaatagttaaaatgtttacattgagcactagaacatgtttggccttttttttctacgttatgcaaaatgcccagggatttaatgcacaggtgtactttaatgtttagggtcagtttgtagtattcttgagaaaaagataaagggttataatttgaatgtgaactgatccagaaataagtgctgtacctttccactgcacttgaagttcaacttaatggtgtatgtgaaaaacaaaaactactttggttgtgtatgtccaaagtcctatggttttattcatttatggttttacaggctttgaagtactcagatttgatttttgctttcttggaaagactcactttaccaagcatataaaggaaaaatgatttcaaacattgacaagatagatgagtgttaacaaagctttcttttttcgtgtcctccttatttaaaaaggtatacttacaatgtgaagtaacttatgaataaaaggaaaagtttatcccatattcaaataattcctaaggtcagcctccctttttgtaagtggcaaatatctgattaaatcatttctcagtttattaatccttggaaacaatgatatagcagttactcacagcttgtaaattacaacagaaaggttcctttcaaatagtagagctgcacctaaagaggaaattgggtttataagaaaatggaggcaaagaacttaagttttaagaaaaagcacttcaaaacagaagggcaaatggaaaaggggaatataaaacaaaccaataaaaataccatctgagggtgttactgtccaaaagtaaagaataagatgcatcactaagccctttgcactcgttatgacctcgtaagtaaaaattatcacttagaataaggggtgcacactacattccctctgtcttctagacttttttttttgtagaagaatcagaaaacaatttactaacctccctgtttgatattaaaaataggaagaattttaatattttctgttagtacaagttgaacttgattgtgccaactgaaaccccagaggtttgtatatcagtagaatgcaagaacattgttaaaggtgcttacgatcttttttgttttcctttccactccattgtatcaattttttgagtaacttttaaatggctagaaaatggtctttttgctttgcccttttaaagctgaaataaccagctccattcttttcatgaatagtaagttgatatatttatttatcaggtatcttgcagttgtcaccaaatactgtagttttcttatgttgtatggaaattatagttcaattattttaatgtgatagagtgcaacaagtcattgtagaacttttcacctgttaatgttgaagttatacctctgaatttctgctgtggatatcaaggaaataataaagcagaaaccccaagaaatttgcaacttaacagtttgagactgtctcttatcctagtatttgggaagagaaggaataaatttgtcaaaactaggtgagaaaatagagcattgtgggaaaaactgagtccaactagattagcaaatgttaattcctagctcaaactgtgaatagtaaggattgaaaagtaaagtatgtaatgctaagggctgtgttgtcttttcttacgattttaagttttaaaggctgttaaattacagagatgttgcccaaggatacatggggattctcaaaagtaagagatttttacctttttcataatctgccaagctggttcctaatatattgttaaattggtagaaaaatatctttaaattggtgtctgctcaagaattgcttttctagatttgatggagggagggggagagtcacatcatttggattctaccaatctgcaggctctatctttggcaacatgtaaataattagactatacatctgtttctcaagtatggcaagaccaatagtttgaatttaattatcaatgctatggtatactttctggtcatattttagttatgtcagttttaaggtaagttttttcatttattaaagcccttaaatgagattttagactgccaaagagaagaggcagtccaattgacctaactgaaatgagatgaccagtatatagagcctagatggactgtagcagctctacccctttgttttacaaggtaaatcattttaaaaattaccttttttgatcagtgggtaaaagttaaagggatctttaatttttgatatattcaagttaattttctaaatgtgaatcagtccttggactgcaactatatattcacctacaaaatcccaatcaaaaaattacatgagcctgtcaagcagatctttagttttccacttcacataagatcgttaatgttctaaattaatctattcatttagatgatttttgtcagttcttaaatgggatataataaatttagcattttcatcttaacaagcaaaagagttaaaaaacaaaacaaaacactactccaagccaaatacattctagctggttaattccagacttgtcccaagtggttccccaacctcttttccactggtaatttcttttcatgcaggcagaatataggggtgcgagcgctgtgagttttacatatgagcttggataggggaactgaagcgagtcaggagccctgctggaaaaggggtttgccattggattgtctgtggcctggtttctttccagtagtacagtaatagggtagattgaaaacaagtatttacttctgattctgcctgcatttagtgtgaaatgctcttaaggtattgcttctaaaaagcaaattaagcagttaagtataaagtccctgaattcatatttcaaaataaggcttttatgagatttttattaaaaattgcaatagccatcacaaatctgagtttttctaggggtgagagaaaactgtattgtgatgagctagattagttgtagttccagaataagaacaaaaattcagagttgtgtggtgcccatcattgagtaaatgaaccctaaaaatgaataagctaatgaactagttcatggaattatttctgatggtcttttgacctgatgctgccatactgcagtgttaccagctccccctagaaaacggaactgtttaaaaacacagcaagttacagaaaccattttattctacagccattggggtacttcagtttatgggatgtttttggaaacttctgctttgggagggatgaagatcattgataaatgttatttgctttctgagttttggggtcatttcattgcttatcaatgaagggcagacagaggagagaatatctcaagtcttttctgataaaaggcttgcttgagggagcttataacttgcacctagagggtttacccactttgtggatttgatttatccaccaaccacagcaaccaataatgtcaagattctaggagtttatgaaagaggctagtatgttttcattttgagtcagacattcttttctcattctcaaatctgttttaaatgctccaattttaaaaatgccaatgaaaattttataatgcttctgtagtaaccatatgcagtttactttgaatttaggaaaacagttttgtatgatgaaatattgtgcagaatctgtaaataaggtagcttaaaaattaaaaaaaagtctaattagaa

SEQ ID NO: 112220 - DNA, 7605 bp, Homo sapiens
  Payload ID: 1978
  Gene Symbol: BRWD1
  Gene Name: bromodomain and WD repeat domain containing 1
  Uniprot ID: Q9NSI6
  ENST ID: ENST00000380800
  CDS Start-End: 100-6699
gcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcggagctgtacttccttatcgcccggtacctatcggcgggcccgtgtcggagagcggcccaggtgctggtgcaggagctggagcagtaccagttgttgccgaagagattggactgggagggcaacgagcacaacaggagctacgaggagttggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaagactgcaggcacacagtttggaagggctctgcctttgctgctcttcatagaggaagacctcctgaaatgccagtgaattatggttccccaccaaatcttgtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacaggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacagtttagcccgatggccaaaggctctcaaagatacatggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaaggaggagagtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaatcatcagaaaggaggaaaagaaatagacctataacaaatggttctacattatctgaaagtgaagtggaagattctttagctacctctttgtcatcgtcagcttccagtagttctgaggaaagcaaagagagttccagagctcgtgaatcctcctcacgcagtgggctatccagaagcagcaatctcagggtaaccagaactagagctgctcaaagaaaaactggtcccgtttcattagcaaatggatgtggcagaaaagccactcgaaagagagtctatttaagtgattctgataacaattcattggagactggtgaaattctaaaagccagagctggaaataaccgaaaagtcttaaggaagtgtgctgctgtggctgccaataaaataaagctaatgagtgatgtagaagagaattctagctctgaaagtgtctgttctggtcggaagctgcctcaccgcaatgcttctgctgtagctagaaaaaagttattacataattctgaagatgaacagagcttaaagtcagaaattgaagaagaggagctaaaagatgaaaatcaactattaccagtgtccagttctcacactgcccagagcaatgttgatgaatctgaaaacagagactcagagtcagaaagtgatttgcgggtagcccggaaaaattggcatgctaatggttacaagtcccatactccagcaccttcaaagacaaaatttcttaaaatagagtcttctgaggaagactctaaaagtcatgattcagatcatgcatgtaacagaactgctggcccatcaacgtctgtgcagaaacttaaggcagagagcatctcagaggaagcagattctgaaccaggaagatctggtggtaggaaatacaatacatttcacaagaatgcgagtttctttaaaaaaaccaagattctgagtgactcagaagactctgaatctgaagagcaagatagagaagatgggaaatgtcataaaatggaaatgaacccaatttcaggaaatctgaactgtgaccctattgctatgtcccagtgttcctcagatcatggatgtgaaactgatttagattcagatgatgacaaaatagaaaaaccaaacaattttatgaaagattctgcatcacaagacaatggactaagcagaaaaatttccaggaaaagggtctgttccagtgactcagacagtagtttacaggtggttaagaaatcatcaaaagccagaacaggtctcctgaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaagacaaaaccttttctcctgtgtatctttgaagtggcagacaaggcgaagcatcagactggtattaatgttagagaatgttctgaagtgttcctattttgtagttatctattccatttgacatagtagaaggtacattttctttctactctgatgcatggggaaggatgtttttggacattatcaactgagataggtgggaaacctcctctcatttgtggcttagagagctatcaccatttcagaactatgatgcttttcttctcagaacttgtgttaagtagatagtaaacagattgattcatgataattgtccttgactaagactgaaaagactaatgggatgccttttactttgctaattttaaaaactggtgatagatgtcaaatccattaatttatttaaactcttcttaaccttctcttttataatctgttctcaggttttaactccatgtttaccatcatttgcaaaaaggtaccaaaaaaatccataaataaatatggaatacattcataagtacatacattcttttggtataaaacaatattttgacagtttaggcttcattaatagaactattctgattatttggactgcattaattggtcattgactggccatccaattaccattttttctttcagtccaaaatagttagacccttgcatacagaagtggtattttggtttttaatcagatttggtttcatcagaagcagcaagaatggacctgatgtctttaaaagcatagccgacaatggtagcttctcaagttatgaaataaaactgagagataatggagaaaataatttttatgggtttttttggttatggtgctattcctaaggttaactttgaatatgtgacacacacactcctaagtacctttaaggaaaattaataaatcattaatagttaaaatgtttacattgagc

SEQ ID NO: 112221 - DNA, 1644 bp, Homo sapiens
  Payload ID: 1978
  Gene Symbol: BRWD1
  Gene Name: bromodomain and WD repeat domain containing 1
  ENST ID: ENST00000455867
  CDS Start-End: 1-1644
ggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataaggagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaag

SEQ ID NO: 112222 - DNA, 1682 bp, Homo sapiens
  Payload ID: 1978
  Gene Symbol: BRWD1
  Gene Name: bromodomain and WD repeat domain containing 1
  ENST ID: ENST00000445245
  CDS Start-End: 1-706
ggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaaga

SEQ ID NO: 112223 - DNA, 4990 bp, Homo sapiens
  Payload ID: 1978
  Gene Symbol: BRWD1
  Gene Name: bromodomain and WD repeat domain containing 1
  ENST ID: ENST00000446924
  CDS Start-End: 1-1923
catgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaagaacatcatgtcgtcgacgaattactcgattttgtagtagttcagaagatgaaatatctactgagaatttatctcctccaaaaagaagacgaaagagaaagaaagaaaataagcctaagaaggagaatttgcggaggatgactccagcagagcttgcaaatatggagcatttatatgaatttcaccctccagtttggattactgacaccacacttagaaaatctccttttgttcctcaaatgggtgatgaggtaatatattttcgacagggtcatgaagcttatattgaggctgtaagaagaaataatatttatgaactgaaccctaataaggagccatggagaaaaatggatcttagggatcaagaattggttaaaatagttggaatacgatatgaagttgggccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaaggaggagagtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaatcatcagaaaggaggaaaagaaatagacctataacaaatggttctacattatctgaaagtgaagtggaagattctttagctacctctttgtcatcgtcagcttccagtagttctgaggaaagcaaagagagttccagagctcgtgaatcctcctcacgcagtgggctatccagaagcagcaatctcagggtaaccagaactagagctgctcaaagaaaaactggtcccgtttcattagcaaatggatgtggcagaaaagccactcgaaagagagtctatttaagtgattctgataacaattcattggagactggtgaaattctaaaagccagagctggaaataaccgaaaagtcttaaggaagtgtgctgctgtggctgccaataaaataaagctaatgagtgatgtagaagagaattctagctctgaaagtgtctgttctggtcggaagctgcctcaccgcaatgcttctgctgtagctagaaaaaagttattacataattctgaagatgaacagagcttaaagtcagaaattgaagaagaggagctaaaagatgaaaatcaactattaccagtgtccagttctcacactgcccagagcaatgttgatgaatctgaaaacagagactcagagtcagaaagtgatttgcgggtagcccggaaaaattggcatgctaatggttacaagtcccatactccagcaccttcaaagacaaaatttcttaaaatagagtcttctgaggaagactctaaaagtcatgattcagatcatgcatgtaacagaactgctggcccatcaacgtctgtgcagaaacttaaggcagagagcatctcagaggaagcagattctgaaccaggaagatctggtggtaggaaatacaatacatttcacaagaatgcgagtttctttaaaaaaaccaagattctgagtgactcagaagactctgaatctgaagagcaagatagagaagatgggaaatgtcataaaatggaaatgaacccaatttcaggaaatctgaactgtgaccctattgctatgtcccagtgttcctcagatcatggatgtgaaactgatttagattcagatgatgacaaaatagaaaaaccaaacaattttatgaaagattctgcatcacaagacaatggactaagcagaaaaatttccaggaaaagggtctgttccagtgactcagacagtagtttacaggtggttaagaaatcatcaaaagccagaacaggtctcctgaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaagaatttgttcctagagacagagaacccaatacaaaagtgagaacatgtatgcataatcagaaggatgcagtgcagatgcctagtgaaactctgaaagcaaaaatggtacctgagaaagttccccgcagatgtgctactgttgctgcaaataaaataaagataatgagtaatct

SEQ ID NO: 112224 - DNA, 1656 bp, Homo sapiens
  Payload ID: 1978
  Gene Symbol: BRWD1
  Gene Name: bromodomain and WD repeat domain containing 1
  ENST ID: ENST00000430093
  CDS Start-End: 1-799
ggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaaga

SEQ ID NO: 112225 - DNA, 1593 bp, Homo sapiens
  Payload ID: 1978
  Gene Symbol: BRWD1
  Gene Name: bromodomain and WD repeat domain containing 1
  ENST ID: ENST00000445668
  CDS Start-End: 1-1228
ggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaaga

SEQ ID NO: 112226 - DNA, 1756 bp, Homo sapiens
  Payload ID: 1978
  Gene Symbol: BRWD1
  Gene Name: bromodomain and WD repeat domain containing 1
  ENST ID: ENST00000412604
  CDS Start-End: 1-1402
ggtttccactggtgctgatgggacagtttgcttttggcaatgggatttagaatccttaaaatttagcccacgtcccctgaagttcactgaaaagcctaggccaggcgttcaaatgctttgttcttcttttagtgttggtggtatgtttttagccacaggtagtactgatcatgtaatcagaatgtattttttgggttttgaagcacccgaaaaaatcgcagaacttgaaagccacactgataaagtagatagtatccaattttgtaacaatggtgatcggttcctaagtggtagcagagatggaacagcacggatttggagatttgagcagttagaatggaggagcattttattggatatggctaccagaatctcaggggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatgggacatgctgatgaagtatttgttctggagacacatccctttgattccagaattatgttatctgcaggacatgatggcagcatatttatatgggatattacaaaaggtaccaagatgaaacattattttaatatgattgaaggacaaggacatggagctgtgtttgactgtaagttttcacaggatggacagcattttgcctgtacagattctcatgggcaccttctgatatttggttttggatgcagcaaaccatatgaaaagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggaagctggaagacttccgattagagaaaggtgaagaggaaagaaatctttatataataggaagaaaaagaaagactcttcagctctcacataagtcggattcagtggttttggtatcacagtctagacaaaggacatgtaggcgtaaatatccaaattatggtagaagaaatcgtagctggcgtgagttatcttctggaaatgagtcttcaagctctgtaagacatgagacttcctgtgatcagagtgaaggttctggttcttcagaagaggatgaatggagaagtgacagaaaaagtgagagttacagcgaaagttcaagtgactcttcatctagatattccgattggacagctgatgcgggcatcaatttgcagcctcctttaag

SEQ ID NO: 112227 - DNA, 1356 bp, Homo sapiens
  Payload ID: 1978
  Gene Symbol: BRWD1
  Gene Name: bromodomain and WD repeat domain containing 1
  ENST ID: ENST00000424441
  CDS Start-End: 1-1356
gccccctacactctgttgcctaaaactagcatttatagatccagcaactggaaaacttatggacaaatctttctctattagatatcatgatatgccagatgttattgactttcttgtattgcgtcaattttatgatgaagcaagacagaggaattggcagtcttgtgacagattccgctctattattgatgatgcttggtggtttggaacagtgttaagtcaagagccatatcaaccacagtatcctgatagtcatttccagtgttatattgttaggtgggataatactgaaattgaaaaacttagcccatgggacatggaaccaattcctgataatgttgatccacctgaagaattaggagctagtatttctgtcacaacagatgagctagagaaattgctctataaaccacaagctggtgaatggggtcagaaatcaagagatgaagaatgtgatagaattatcagtggtatagatcaacttttgaatcttgatatagcagcagcttttgcaggccctgttgatttgtgtacatacccgaagtactgtactgtagtagcttatccaaccgatctttacacaattcgaatgagacttgttaatcgattttacaggaggctgtctgcgttagtttgggaagtcagatatatagaacataatgccagaacatttaacgaacctgagagtgtaattgcaagatcagctaaaaagataactgaccaacttttaaaatttatcaagaatcaacactgtacaaatatctcagaactttctaacacatctgaaaatgatgagcaaaatgctgaggatttggatgatagtgatcttcctaaaacatcttctggaaggaggagagactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaatcatcagaaaggag

SEQ ID NO: 112228 - DNA, 11381 bp, Homo sapiens
  Payload ID: 1979
  Gene Symbol: BRWD3
  Gene Name: bromodomain and WD repeat domain containing 3
  Uniprot ID: Q6RI45
  ENST ID: ENST00000373275
  CDS Start-End: 218-5626
ctctccttcctcctccgcctcctcagctcttgggctagaatatctatgggtcgaaacgtgatgcgatgaattcgagagagagcgaaactaggacgaggagtgcggcggaagcggcgggactcccgggcatgggggcttcaccacaatagaggcagcgcccccacccgcccccgccagcccctccggagcgaagcccccaaaccccctcgggaaaaggatggcggcagcacctacccagatcgaagccgagctgtattacctgatcgctaggttcttgcagtctggaccctgcaacaaatccgctcaggtgctagtgcaggagctcgaggagcatcagctgattccgcgccgcttagattgggaggggaaagagcaccgaagaagcttcgaggatctggtggcagcaaatgcacacattcctccagactacctccttaaaatttgtgagagaattggtcctttactagataaagagatccctcagagtgttcctggggtacagacattattaggtgttggtcggcagtctctgctacgggatgccaaagactgtaagagtacactatggaatgggtctgcttttgcggctctgcatagaggcagacctccagaactacctgtaaattatgtgaaacctccaaatgtggtgaatatcacctctgccaggcaattaaccggctgtagtcgctttggtcatattttcccttcatctgcttaccagcacattaagatgcataagagaattctggggcacttgtcatctgtctactgtgtagcatttgaccgaagcgggagaagaatttttacaggttcagatgactgtttagtaaaaatttgggctacagatgatggacgccttcttgctacacttcgtggacactctgctgaaatttctgacatggctgttaactatgaaaacactcttattgctgcaggcagctgtgataaggtagtaagagtatggtgtcttcgaacttgtgcacccgttgcagtccttcagggccattcagcttctattacttccatacagttttgtccatcaactaaaggcacaaacagatacctcacttctactggtgctgatggaacaatctgtttctggcaatggcatgtaaaaacaatgaagtttagagatcgcccggtgaaatttactgagagatccagacctggagtccagatatcttgttcatctttcagttctggtggtatgttcattacaactggtagtactgaccatgtgattagaatatattatttgggttctgaggttcctgagaaaattgctgaattagagtcacatacggataaagttgttgctgttcagttctgtaacaatggagacagtttaagatttgttagtggaagtcgagatggaacggcaagaatttggcagtatcagcaacaagaatggaagagtatagtgctagacatggctactaaaatgactggcaataatttgccatctggagaagacaagatcactaaacttaaggtgactatggtggcctgggatcgctatgataccacagttattactgcagtgaacaattttcttttgaaagtgtggaattctatcacaggacagcttcttcatacattatctggacatgatgatgaagtattcgttctagaagcccatccatttgatcaaaggatcatactttcagcaggtcatgatgggaacatttttatttgggaccttgaccgggggaccaaaattcggaattactttaacatgattgaaggccaaggccatggtgcggtgtttgattgtaaattttcaccagatggaaaccattttgcctgcacagattctcatggacatttgctgctttttggttttggatgcagtaaatactacgaaaagattccagatcagatgttcttccacacggattatcgtcctcttattcgtgatgccaataactatgtattggatgaacaaacccaacaagctcctcacctcatgcctcctccatttttggtggatgttgatggaaatcctcatcccacaaaattccaacggttggtaccaggacgggaaaattgtaaagatgaacagcttataccacagctgggatatgtggctaatggtgatggtgaggtagtagaacaggtaattgggcagcaaaccaatgaccaagatgagagcattcttgatggaataatcagggagctgcagagagaacaagacctgagactaattaatgaaggagatgttccacatttaccagttaatagagcatactctgttaatggtgctctgagaagtccaaacatggacatatcttcttccccaaacatcaggcttcgaagacatagtagtcaaattgaaggtgttagacaaatgcataacaatgctcctcggagccagatggccactgaaagagatctcatggcgtggagcagaagagtggtggtcaatgaactaaataatggggttagtagggtacaggaagaatgtcgaactgcaaaaggtgacatagaaatcagtctttatacagttgaaaagaagaaaaagccatcttacactactcaaaggaatgattatgagcctagctgtgggcgttctttacgcaggacacagcgcaaacgtcagcatacttaccaaacacggtccaacatagagcataattcacaggcatcatgtcaaaattcaggtgtacaggaagactcagacagttcttcagaggaagatgaaactgttggcacaagtgacgcttcggtagaggatcctgttgttgaatggcaaagtgaaagttcttccagtgactcatcaagtgaatattctgattggacagcagatgctggaataaatttacaacccccaaaaagacaaaccagacagacaacacgtaaaatatgcagcagctctgatgaggaaaatttgaagtccctagaagaaaggcagaagaaacctaagcagactagaaagaagaaaggaggactggtttctatagcaggtgagcctaatgaagaatggtttgcccctcagtggatcttggatactataccccgacgttccccatttgtcccacaaatgggagatgagcttatctattttaggcaaggacatgaagcttatgttcgggctgtaaggaaatcgaaaatatacagtgttaatttacaaaaacagccatggaacaaaatggatctcagggagcaagagtttgttaagattgtaggaatcaaatatgaggttggcccacccacactgtgctgcttgaagcttgcatttctggacccaatttcaggcaaaatgactggagaatctttttccattaagtatcatgacatgccggatgtcattgacttccttgtgctacatcagttttataatgaagccaaagaaaggaactggcagattggtgatagattccgcagtataatagatgacgcctggtggtttgggactgtggagagtcagcagccttttcaaccagagtatcctgatagttctttccagtgttacagtgttcactgggacaataatgagagagaaaagatgagcccatgggatatggagccaattccagaaggaactgcctttccagatgaagttggtgctggtgttcctgtctcccaggaagaattgactgctttgctatacaaaccccaggaaggagagtggggggctcattccagagacgaagaatgtgaacgggttattcagggcatcaaccaccttctttccctggattttgccagcccttttgctgttccagtggatctcagtgcctaccccttgtattgtactgtagttgcttatccaactgacctcaataccatcaggcggagacttgaaaatcgcttttacaggagaatatcagcattaatgtgggaggtacgctatattgaacataatgccaggactttcaatgagccagacagtcctatagttaaagcagctaaaattgtaactgatgtcttacttcgatttattggggatcagagctgtactgatatactggatacttataataaaattaaagcagaagaacgaaacagtactgatgcagaggaggatacagaaattgttgatttagattcagacggtcctggtacttcatctggaagaaaggtcaaatgccgaggcagaagacagtctttaaagtgtaatcctgatgcttggaaaaaacaatgcaaggaactattgagcctcatttatgaacgtgaagactcggagccatttcgacagccagctgatcttctttcttacccaggtcatcaggagcaagagggagaatcctcagagtctgttgttccagaaagacaacaagattcatctctttctgaggattatcaagatgttatagatactcctgtggacttcagcactgtgaaagaaactttggaagcaggaaactatggtagtcctctggaattttataaggatgttcgccaaatattcaacaactccaaagcttatacctctaataaaaagtcaaggatctatagcatgatgctgcgattatctgccttatttgaaagtcatatcaaaaatatcatctctgaatataagtcagcaatccagagtcagaagaggagaaggccacggtacagaaaacgtctaagaagcagcagcagttcattatctagtagtggagcacctagtccaaaagggaagcagaaacaaatgaagttgcagcctaaaaatgaccagaatacctcagtatctcatgccaggactagctctcctttctcatctcctgtttcagatgctgctgaagggctttcactatatctacttgatgatgagccagatgggccattttcttcatcgagcttcggtggatatagccgaagtggaaatagccatgacccagggaaagccaaatcatttcggaatagagttttgccagttaaacaagatcactcccttgatggaccccttacaaatggtgatggcagagagccccggacaggaatcaagagaaaactacttagtgcatcagaagaagatgaaaacatgggaggagaagataaagagaaaaaagaaacaaaagagaaatctcatttatccacctcagagagtggagagttaggatccagtttaagttctgaaagtacctgtggttctgactctgactctgaatcaacttccagaacagatcaagattacgtagatggagaccatgattatagcaaattcatacaaaccagacctaaaagaaaactcagaaagcaacatggcaatggaaaaagaaattggaagaccagaggcacaggaggaagaggcagatggggaagatggggtagatggagtagaggaggcagaggaagaggaggcaggggacgagggagtcgaggaagaggtggaggtggcactagggggaggggaagagggagaggaggaagaggtgcttctagaggagctaccagagccaaacgagcacgtattgcagatgatgaatttgataccatgttttcaggacgtttcagtagactgcctcgaattaaaacaagaaaccaaggcaggaggactgttttatataatgatgattctgataatgacaattttgtgtccactgaggatcctctgaatcttggtacatccagatcaggcagagtgcgtaaaatgacagaaaaagccagggttagccatctcatgggatggaattattaacagttaataaatttagaataacttaaaaaattcaatggccttctactgcagggaatttaccaggaaatctacaaagcaagttgtgtggggacttctgcttcctttcacattggtgcttttccatttatgccagtatacatttgtttcaagacttttgatctccacacttcatttgttcaaataagccttactcattaggccttaaattaaaagaaattctgcccacacacacacaaacacatacacacacatacacacacacagacacacacacacgaaacacaacacagacactacagatttactacattaaaggagcattcagcttcttaagagtagcatgacatttttatctcaatagaatagccctcttttgcttttgtatcacagaagtatagcaccttcttacagagttttatatagtttgtttttgccattttgattcctatacccagtaataataacttttgcacaatacaccaatcctaaaggcagctattaaatgtttacagtttctatattgtaagagcgatctggattattttactcttcccaggccaaactttcatgacttgtactgaactgaagtatatatttatactacagttttttggggggtggggggatcttgatatgcttttcattgatttgcataattcacgttaaaggtgagaaagggttggtgccttgtaaatatgtagcagatcttcgtggtgtgttctgatgtgtgcattaactttattaaaaaagaatacttgaggtatcaatctagacaaggtgccaaatgcaaaagtttcccgcatcaatttttttcctatcacattttattgcattaatagaatttgtgtagcttaaataacttaaacatttgaaaaatcctcatccacaaagaacaacttctttgaacagtagctcagctacctcttaactacaactactggaaacattaaggaaaatagatgctgttattccttactgactaaggagaaatagaacaagcttagtaggaatgaataccccataagttataagctgagaggttgttaataattgtattggctctcaaattaataattgtaattaacaaagtttcataaatatagtatgctctaccaccttaggctttcttagaacatatttgtgtaagtagacttgggctactgcttatatatttctgctccacttaccatttaacagctgtgagttgctggttttcatttgaatcttaaaatttaacaaagcacctggtttgatttggaatgttttggctagctagtattatgaatcaacttatagattctgctcatatcattccaaagggttcttctgttctagtctttcaggaaagaaccttattgcactgcacactcatgttgtgaatcattattttatagataaaaaacatctttaaaaacccttattgtcttgtttacagcagtagagtgcacatggttccataagtgagcttgagttccaaggtcagttttactccccaaatttaatattacagatttgttcatttgttagatacttacatttctgaggtaagagggataatagcaatttctgtttctgtaacagcaaatttgttgcacttagatcaggctcatgggataaaacagacttcttagtatatacctagctatcccaggatatttcttaagctaatgtgtttgtctcatgctttcaatcatttcatgcatctgaaaacccttaagtgcagaggaaggcgtacacacataaaactttgcttttttggtagggtcggcagtagggttattcttggactaacatctttaagcagttttcacttgcagtggaaatgatgttcaggctttaagagaaagtattgtgaattgttaatggcactaacttctgttactagacagcagaccaagctatttttttgttgtagtctttttttcactaaaccaaaactacttctggttgtaactcagctgccactttaaaccatagtagagattcaaaacgttcctatttgaaactacatttgatttttgctaaaatgtgctgtttcggttatttatctcttgggcatttagactaaattgtgcctgtattcctgaaatcaataatactttggcttatcctgatctaagtaacatagttacttaaattcctggatatacccaaatatggatcacatgtatcattttagtttgaaattttttgttgacattcttctatgaagagctgacctcttgaaatgtagaagaattgacatttgtgtgattttggctatctggagctttatttataatttattttgaaaaataaaaatgccacatttatttcccaaatgtcaagattttctagaattagataattagaataataaggctgaagacattttaaagcatattttatatgtagtgaaatactgtgaaaatattagtgaacagcattttgctgtaatgtttatttcagttattaagatttaaagagttagtcatcagggtatgttagataaacatagttatcatttattaaacaaacagataattttctgtttgcatgcaaattattttaataagtgtgaaaataaaagtttggaagatagtatttttacttttatatctggacttttttttcccccaatttacactttgctttcttgtaataccacctcctgtgaatgtgttgtaattagtatcacattgattactttatcattttaatttctttgaggccctttaaacctacgtaaaatctgggtccagccatagcaaagcaagtacaaaatgaacaaagaattttgaagaaaagcctaaatcttaaattgctaagaaaaaacactgttatatttaggcccgtgagagcatatacatgtataaacctaatcctatgctagatatgaatagtcagtgagctgtaatatttctcataaatgctaataatgtttaaattcccagctttaagatcttagtgtgtgtatatatttataaaatctgaattgtgtgtttcttctatggcttactgtgtgtttctctttcagcaataggatgctctctaaaacattcactagcctactagcctacttactaaatttttgtatatgtgtgtttgtgcacttgtatgtgtgtaaagttttttccccaacttgacacaccttatctcagacattcaaaaaaagagaacattttgtatggaggacagtctgccaactttttgcctctctacagctcttagcctgtatatttactgcttgatcattcattatgccttctagataaccagtccaggttttgtcatatacctgtgtccctctattctttttatttccctttttaattttttttcttttttttccctccccagaaatcaggcttgtgttggaattcttctctataatactttgtttcccgcagatgcaaagtaacaaagtaactgagtaaaattagaaatctcattctgcacaactgtgcgctcagatatttaactcagccttctaatacttttaagtacgtttctgttatttatctttttgttgtttttgttttaatcccatagattgtcatcagacaataatagagtgattgagagagaaagatataaatgccacttctaactttttgataaaacttttttgagcatttttcaaaaatttgtatgtttgtggtaatggggaattaaacaccttttacagctgatgtatgttggaaatcattttatgtacatttaccaactggtacttatcttcaagttggaattttcacatccataaaagggagacttgcatcatatataattttcagtatactttgctgtccagccttttaaacaattacagtaacattttgagttctgtgatgaatagttctaggggaagggatggaactttcgacatgtaaagtccattgttttaaatgctaaccccatccccaatatttttgtggaacgtgaggctttatgaaaggtttatcagaaatagaatattctaaagtcacttttatggcttatttcaaaaactagtgtgaaagtattttcatgcttttttgtttctcatcttttagcaaagcttctttaccaagttttgattaaattgcaatataaaattaagttttttcacggtgctatattttgtggaatatgggtagcactcaggtttctttcttttttcttttctccttccttcttccttcattccttcattcctccctcccccctccctccctccctctcttccttccctccttccttccttcctcacctcggcctcccaaagtgctgggattacaggcatgagccaccgtgcccggcctatatacccttattcttgattatttcttttttcatcttttcaatcctgcttacttttatcctcacttttctttctgccatgaaaactgcacctaatttaccacacttaagattggcaatttttgattcattgatgggagaagtacagtagaaaggccctgcagtttagaattaagttgtgtttgtttatttacatgtatgcccatttcttctaaattaaatctagaatgtgagactttgacatataaaagcatgataagtattttcttaaaaaataagactattgatacataatgaaaccaccattggtaattgaattttaaaatgatatgcaaaaatatttagaaatccagttgggaaatgtgtttttgcatatgtcaccagatacacattaggcagtactacaaatgttaattcttaaacaatactgtggtgatggcaatcagtaatttatttctttgtcctgtaacttatcattcttgtcttttgtaatgtcttacacagtattaacataactgtaccttttttttgttcttggtatccatacattttaagatggaaaatcagttcatagttgatatgatattgtatatgggcaaaatgtccgttaaactaaaattcagtaaaaaaggtaatataaactggcttgatttataaaagatgttttgtttggcagttatcagtcattataagcaattatcttcaaagacaaaaaaactggactaatttgttgccattctttatgggatgtttacaataaaattccaagttgtttggaatcaattgcactcttgctgctttatgccttaatttatgtaccagagaaaaattaaccagaagaaagaaatatggagttacctattcagctttagagattgtaacatgtaactcttaggtctttcttgtttctttgtcatagaatattttattactattactttttaatctgagaaactaggatgcttcttcctatcaaagaaaaggttttgttttttgttttcatcttagacattgcaaatattctttgggtcacttttaggataataaatatgatgtttacactttaaatgtgggctgcttggtgcattcaataacagcctgcaaagcatttgtcaacattttgttttgcagagcttttcaaaatgaatagatctctaacatatttatgacttacaacttttaacagctgagttatatgtacctgacattttaaaatgtatagtaagattacctacattgtaaatggtgctttaattcagtgtaagtgtaggagagagagaagtgaggtgagatgatctgaatgctctaacaggaacattcataactatatagttacccagaatttgtctcccagtggcaaacattccactaggttcaagataaataagctggccaaagactggactgtatctttgatatatatatactgtgtattttgtgtatttagaataaaaaaaatgcatttaggaaaaaa

SEQ ID NO: 112229 - DNA, 4614 bp, Homo sapiens
  Payload ID: 1980
  Gene Symbol: BRD1
  Gene Name: bromodomain containing 1
  Uniprot ID: O95696
  ENST ID: ENST00000216267
  CDS Start-End: 488-3664
atccgataggaccaggtagccactgagcatgcctgtctggtgggcatagcctctgtgcctggtggggtccagccctgtatgtggacttcctgggggaccgcctgcatgctgggaaagtcctgcaactgtgggctctgggccggacccctcctccttggggagcgttgctgtggtctccgcagcctgttggtgtggtctgagaggggactggtgtgtggtggtagggacgcaggtgctcaggagggctcctcaggctgcctctctgcctgttactgctgctccctccctggtcctggggactcgctcaggcctggatgtgtggttttggacaccttggaaagaggttagctgtgagttttgctttgattgggctttgagctgctgagctagatctgtccaagcatgcttttgtggttttctcgagtctttggtcaccctgcgtagaattacctttacttttgccttcattttaggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagatttgga

SEQ ID NO: 112230 - DNA, 4312 bp, Homo sapiens
  Payload ID: 1980
  Gene Symbol: BRD1
  Gene Name: bromodomain containing 1
  Uniprot ID: O95696
  ENST ID: ENST00000404034
  CDS Start-End: 186-3362
caatctagtttcaacatacaatgaggatttctgtctgatacagagaaagatacccagtgtctggagggtctgtcttaagaagtgctcttgaagtctgctgggatttcctttcgggactcacagagggaagcctgctccctgagggctttttctcaggcccaatagatcagggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagatttgga

SEQ ID NO: 112231 - DNA, 4550 bp, Homo sapiens
  Payload ID: 1980
  Gene Symbol: BRD1
  Gene Name: bromodomain containing 1
  Uniprot ID: O95696
  ENST ID: ENST00000404760
  CDS Start-End: 31-3600
ccgcggcgccccgaaggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaaggagataaatctccccctaaacttgaaccatcagatgcattacctcttccttcaaactcggagactaattcagaaccaccaaccctcaaaccagtagaactcaacccagagcagagtaaacttttcaaaagagtcacatttgataatgaatcacatagcgcttgcactcagagcgcactggtaagcggacgccctccagagcccacccgcgccagtagtggcgatgtgccggcggcggcggcctccgcggtggcggagccagcaagcgatgtaaacagacgcacttctgttctcttctgcaaatcgaaaagtgtaagccccccaaagtctgccaagaacactgaaacccagccaacttctcctcagctagggaccaaaacctttttgtctgtagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagatttgga

SEQ ID NO: 112232 - DNA, 3051 bp, Homo sapiens
  Payload ID: 1980
  Gene Symbol: BRD1
  Gene Name: bromodomain containing 1
  ENST ID: ENST00000438393
  CDS Start-End: 1-1530
gaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaagctagggaccaaaacctttttgtctgtagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagatttgga

SEQ ID NO: 112233 - DNA, 4997 bp, Homo sapiens
  Payload ID: 1980
  Gene Symbol: BRD1
  Gene Name: bromodomain containing 1
  Uniprot ID: O95696
  ENST ID: ENST00000457780
  CDS Start-End: 488-4057
atccgataggaccaggtagccactgagcatgcctgtctggtgggcatagcctctgtgcctggtggggtccagccctgtatgtggacttcctgggggaccgcctgcatgctgggaaagtcctgcaactgtgggctctgggccggacccctcctccttggggagcgttgctgtggtctccgcagcctgttggtgtggtctgagaggggactggtgtgtggtggtagggacgcaggtgctcaggagggctcctcaggctgcctctctgcctgttactgctgctccctccctggtcctggggactcgctcaggcctggatgtgtggttttggacaccttggaaagaggttagctgtgagttttgctttgattgggctttgagctgctgagctagatctgtccaagcatgcttttgtggttttctcgagtctttggtcaccctgcgtagaattacctttacttttgccttcattttaggtaatcattaccaaatgaggaggaaaggacgatgtcatcgaggctctgcagcgaggcatccttcttccccatgcagtgttaaacactcccctacgcgagaaacgctgacctacgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggttaaataggattgcgaatcaggtggccattcagcggaagaagcagtttgtggagcgagcccacagctactggctgctcaagcggctgtccaggaacggggcccccctgctgcggcggctgcagtccagcctgcagtctcagcgaagctcacagcagagagaaaatgatgaggagatgaaggctgccaaagagaagctgaagtactggcagcggctgcggcacgacctggagcgcgctcgcctgctgatcgagctgctgcgcaagcgggagaagctcaagcgtgagcaggtgaaggtggagcaggtcgccatggagctgcggctgaccccgctgacggtgctgctgcgctcagtgctggaccagctgcaagacaaggaccccgccaggatatttgcgcagcccgtgagtctgaaggaggtaccagattatttggatcacattaaacatcccatggactttgccacaatgaggaaacggttagaagctcaagggtataaaaacctccatgagtttgaggaggattttgatctcattatagataactgcatgaagtacaatgccagggacaccgtgttctatagagccgcggtgaggctgcgcgatcagggaggtgttgttctgaggcaggcccggcgcgaggtggacagcatcggcttggaagaggcctcggggatgcacctgcctgagcggcctgctgcggcaccgcggcggcctttctcctgggaagacgtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaaggagataaatctccccctaaacttgaaccatcagatgcattacctcttccttcaaactcggagactaattcagaaccaccaaccctcaaaccagtagaactcaacccagagcagagtaaacttttcaaaagagtcacatttgataatgaatcacatagcgcttgcactcagagcgcactggtaagcggacgccctccagagcccacccgcgccagtagtggcgatgtgccggcggcggcggcctccgcggtggcggagccagcaagcgatgtaaacagacgcacttctgttctcttctgcaaatcgaaaagtgtaagccccccaaagtctgccaagaacactgaaacccagccaacttctcctcagctagggaccaaaacctttttgtctgtagtccttccgaggttggagactcttctgcagccaaggaaaaggtcgcggagcacatgcggagactccgaggtggaggaggagtccccaggaaagcgcctggacgcaggtctcaccaacggctttgggggtgcgaggagcgagcaggagccgggcggcggcctggggaggaaggccacaccccgacgacgctgtgcctccgagtccagcatctcctccagcaacagcccgctctgcgactcgagctttaatgcgcccaaatgtgggcggggcaaaccggctcttgtgcgacggcacacgctggaggaccgcagtgagctgatctcctgcatcgagaatgggaactacgccaaggcggccaggatcgcagccgaagtcggccagagcagcatgtggatctccactgatgccgccgcctcggtgctggagcctctgaaggtggtgtgggccaagtgcagcggctacccctcctacccggcactgatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtc

SEQ ID NO: 112234 - DNA, 4894 bp, Homo sapiens
  Payload ID: 1981
  Gene Symbol: BRD2
  Gene Name: bromodomain containing 2
  Uniprot ID: P25440
  ENST ID: ENST00000374825
  CDS Start-End: 1702-4107
ggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112235 - DNA, 4807 bp, Homo sapiens
  Payload ID: 1981
  Gene Symbol: BRD2
  Gene Name: bromodomain containing 2
  Uniprot ID: P25440
  ENST ID: ENST00000374831
  CDS Start-End: 1615-4020
ggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112236 - DNA, 4807 bp, Homo sapiens
  Payload ID: 1981
  Gene Symbol: BRD2
  Gene Name: bromodomain containing 2
  Uniprot ID: P25440
  ENST ID: ENST00000383108
  CDS Start-End: 1615-4020
ggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112237 - DNA, 3467 bp, Homo sapiens
  Payload ID: 1981
  Gene Symbol: BRD2
  Gene Name: bromodomain containing 2
  Uniprot ID: P25440
  ENST ID: ENST00000395287
  CDS Start-End: 170-2680
cccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112238 - DNA, 3467 bp, Homo sapiens
  Payload ID: 1981
  Gene Symbol: BRD2
  Gene Name: bromodomain containing 2
  Uniprot ID: P25440
  ENST ID: ENST00000399527
  CDS Start-End: 170-2680
cccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112239 - DNA, 4807 bp, Homo sapiens
  Payload ID: 1981
  Gene Symbol: BRD2
  Gene Name: bromodomain containing 2
  Uniprot ID: P25440
  ENST ID: ENST00000399528
  CDS Start-End: 1615-4020
ggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112240 - DNA, 4894 bp, Homo sapiens
  Payload ID: 1981
  Gene Symbol: BRD2
  Gene Name: bromodomain containing 2
  Uniprot ID: P25440
  ENST ID: ENST00000399529
  CDS Start-End: 1702-4107
ggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112241 - DNA, 3455 bp, Homo sapiens
  Payload ID: 1981
  Gene Symbol: BRD2
  Gene Name: bromodomain containing 2
  ENST ID: ENST00000424160
  CDS Start-End: 1615-3455
ggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaa

SEQ ID NO: 112242 - DNA, 1773 bp, Homo sapiens
  Payload ID: 1981
  Gene Symbol: BRD2
  Gene Name: bromodomain containing 2
  ENST ID: ENST00000452539
  CDS Start-End: 1-985
ggccaaatcgtcttcagagtcctccagtgaggaaagtagcagtgagagctcctctgaggaagaggaggaggaagatgaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcaccccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112243 - DNA, 4894 bp, Homo sapiens
  Payload ID: 1981
  Gene Symbol: BRD2
  Gene Name: bromodomain containing 2
  Uniprot ID: P25440
  ENST ID: ENST00000414731
  CDS Start-End: 1702-4107
ggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112244 - DNA, 887 bp, Homo sapiens
  Payload ID: 1981
  Gene Symbol: BRD2
  Gene Name: bromodomain containing 2
  ENST ID: ENST00000412535
  CDS Start-End: 1-887
ttcgtcccctgggggtacagcagccgggagccaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttg

SEQ ID NO: 112245 - DNA, 1773 bp, Homo sapiens; identical to SEQ ID NO: 112242
  Payload ID: 1981
  Gene Symbol: BRD2
  Gene Name: bromodomain containing 2
  ENST ID: ENST00000447730
  CDS Start-End: 1-985

SEQ ID NO: 112246 - DNA, 4807 bp, Homo sapiens
  Payload ID: 1981
  Gene Symbol: BRD2
  Gene Name: bromodomain containing 2
  Uniprot ID: P25440
  ENST ID: ENST00000449118
  CDS Start-End: 1615-4020
ggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112247 - DNA, 3542 bp, Homo sapiens
  Payload ID: 1981
  Gene Symbol: BRD2
  Gene Name: bromodomain containing 2
  ENST ID: ENST00000416727
  CDS Start-End: 1702-3542
ggaccgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaa

SEQ ID NO: 112248 - DNA, 3210 bp, Homo sapiens
  Payload ID: 1981
  Gene Symbol: BRD2
  Gene Name: bromodomain containing 2
  ENST ID: ENST00000427021
  CDS Start-End: 1-2423
ggaacggtggtggcggctcggctactgctcgtggaggggaatacaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112249 - DNA, 4894 bp, Homo sapiens
  Payload ID: 1981
  Gene Symbol: BRD2
  Gene Name: bromodomain containing 2
  Uniprot ID: P25440
  ENST ID: ENST00000438194
  CDS Start-End: 1702-4107
ggaccgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112250 - DNA, 1858 bp, Homo sapiens
  Payload ID: 1981
  Gene Symbol: BRD2
  Gene Name: bromodomain containing 2
  ENST ID: ENST00000457933
  CDS Start-End: 1-1858
ggaacggtggtggcggctcggctactgctcgtggaggggaatacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaa

SEQ ID NO: 112251 - DNA, 1878 bp, Homo sapiens
  Payload ID: 1981
  Gene Symbol: BRD2
  Gene Name: bromodomain containing 2
  ENST ID: ENST00000442219
  CDS Start-End: 1-1090
ggccaaatcgtcttcagagtcctccagtgaggaaagtagcagtgagagctcctctgaggaagaggaggaggaagatgaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcaccccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112252 - DNA, 3210 bp, Homo sapiens
  Payload ID: 1981
  Gene Symbol: BRD2
  Gene Name: bromodomain containing 2
  ENST ID: ENST00000446150
  CDS Start-End: 1-2423
ggaacggtggtggcggctcggctactgctcgtggaggggaatacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112253 - DNA, 887 bp, Homo sapiens; identical to SEQ ID NO: 112244
  Payload ID: 1981
  Gene Symbol: BRD2
  Gene Name: bromodomain containing 2
  ENST ID: ENST00000429833
  CDS Start-End: 1-887

SEQ ID NO: 112254 - DNA, 3210 bp, Homo sapiens; identical to SEQ ID NO: 112252
  Payload ID: 1981
  Gene Symbol: BRD2
  Gene Name: bromodomain containing 2
  Uniprot ID: P25440
  ENST ID: ENST00000436979
  CDS Start-End: 159-2423

SEQ ID NO: 112255 - DNA, 887 bp, Homo sapiens; identical to SEQ ID NO: 112244
  Payload ID: 1981
  Gene Symbol: BRD2
  Gene Name: bromodomain containing 2
  ENST ID: ENST00000454038
  CDS Start-End: 1-887

SEQ ID NO: 112256 - DNA, 3210 bp, Homo sapiens
  Payload ID: 1981
  Gene Symbol: BRD2
  Gene Name: bromodomain containing 2
  ENST ID: ENST00000439194
  CDS Start-End: 1-2423
ggaacggtggtggcggctcggctactgctcgtggaggggaatacaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112257 - DNA, 3210 bp, Homo sapiens
  Payload ID: 1981
  Gene Symbol: BRD2
  Gene Name: bromodomain containing 2
  Uniprot ID: P25440
  ENST ID: ENST00000449085
  CDS Start-End: 159-2423
ggaacggtggtggcggctcggctactgctcgtggaggggaatacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112258 - DNA, 3210 bp, Homo sapiens; identical to SEQ ID NO: 112257
  Payload ID: 1981
  Gene Symbol: BRD2
  Gene Name: bromodomain containing 2
  ENST ID: ENST00000449025
  CDS Start-End: 1-2423

SEQ ID NO: 112259 - DNA, 3467 bp, Homo sapiens
  Payload ID: 1981
  Gene Symbol: BRD2
  Gene Name: bromodomain containing 2
  Uniprot ID: P25440
  ENST ID: ENST00000442863
  CDS Start-End: 170-2680
cccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112260 - DNA, 887 bp, Homo sapiens
  Payload ID: 1981
  Gene Symbol: BRD2
  Gene Name: bromodomain containing 2
  ENST ID: ENST00000450284
  CDS Start-End: 1-887
ttcgtcccctgggggtacagcagccgggagccaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttg

SEQ ID NO: 112261 - DNA, 887 bp, Homo sapiens
  Payload ID: 1981
  Gene Symbol: BRD2
  Gene Name: bromodomain containing 2
  ENST ID: ENST00000456339
  CDS Start-End: 1-887
ttcgtcccctgggggtacagcagccgggagccaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttg

SEQ ID NO: 112262 - DNA, 3467 bp, Homo sapiens; identical to SEQ ID NO: 112259
  Payload ID: 1981
  Gene Symbol: BRD2
  Gene Name: bromodomain containing 2
  Uniprot ID: P25440
  ENST ID: ENST00000448067
  CDS Start-End: 170-2680

SEQ ID NO: 112263 - DNA, 1773 bp, Homo sapiens; identical to SEQ ID NO: 112242
  Payload ID: 1981
  Gene Symbol: BRD2
  Gene Name: bromodomain containing 2
  ENST ID: ENST00000425016
  CDS Start-End: 1-985

SEQ ID NO: 112264 - DNA, 3467 bp, Homo sapiens
  Payload ID: 1981
  Gene Symbol: BRD2
  Gene Name: bromodomain containing 2
  ENST ID: ENST00000450320
  CDS Start-End: 170-2680
cccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaaactccaggctggagtgcagtggcgtgatctcggcttactgcaacctccacttctcgggttcaagcgattctcctgcctcagcctcccaagtagccagaattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112265 - DNA, 2115 bp, Homo sapiens
  Payload ID: 1981
  Gene Symbol: BRD2
  Gene Name: bromodomain containing 2
  ENST ID: ENST00000425201
  CDS Start-End: 170-2115
cccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacag

SEQ ID NO: 112266 - DNA, 887 bp, Homo sapiens
  Payload ID: 1981
  Gene Symbol: BRD2
  Gene Name: bromodomain containing 2
  ENST ID: ENST00000433783
  CDS Start-End: 1-887
ttcgtcccctgggggtacagcagccgggagccaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttg

SEQ ID NO: 112267 - DNA, 1773 bp, Homo sapiens; identical to SEQ ID NO: 112242
  Payload ID: 1981
  Gene Symbol: BRD2
  Gene Name: bromodomain containing 2
  ENST ID: ENST00000518754
  CDS Start-End: 1-985

SEQ ID NO: 112268 - DNA, 3482 bp, Homo sapiens
  Payload ID: 1981
  Gene Symbol: BRD2
  Gene Name: bromodomain containing 2
  ENST ID: ENST00000477920
  CDS Start-End: 1550-1993
accgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaa

SEQ ID NO: 112269 - DNA, 4834 bp, Homo sapiens
  Payload ID: 1981
  Gene Symbol: BRD2
  Gene Name: bromodomain containing 2
  ENST ID: ENST00000482914
  CDS Start-End: 1550-1993
accgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112270 - DNA, 667 bp, Homo sapiens
  Payload ID: 1981
  Gene Symbol: BRD2
  Gene Name: bromodomain containing 2
  ENST ID: ENST00000496177
  CDS Start-End: 1-413
gcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctg

SEQ ID NO: 112271 - DNA, 667 bp, Homo sapiens; identical to SEQ ID NO: 112270
  Payload ID: 1981
  Gene Symbol: BRD2
  Gene Name: bromodomain containing 2
  ENST ID: ENST00000481259
  CDS Start-End: 1-413

SEQ ID NO: 112272 - DNA, 4834 bp, Homo sapiens
  Payload ID: 1981
  Gene Symbol: BRD2
  Gene Name: bromodomain containing 2
  ENST ID: ENST00000479699
  CDS Start-End: 1550-1993
accgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112273 - DNA, 4834 bp, Homo sapiens
  Payload ID: 1981
  Gene Symbol: BRD2
  Gene Name: bromodomain containing 2
  ENST ID: ENST00000493063
  CDS Start-End: 1550-1993
accgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112274 - DNA, 3404 bp, Homo sapiens
  Payload ID: 1981
  Gene Symbol: BRD2
  Gene Name: bromodomain containing 2
  ENST ID: ENST00000492172
  CDS Start-End: 1573-2778
gctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagag

SEQ ID NO: 112275 - DNA, 3404 bp, Homo sapiens
  Payload ID: 1981
  Gene Symbol: BRD2
  Gene Name: bromodomain containing 2
  ENST ID: ENST00000486864
  CDS Start-End: 1573-2778
gctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagag

SEQ ID NO: 112276 - DNA, 3404 bp, Homo sapiens
  Payload ID: 1981
  Gene Symbol: BRD2
  Gene Name: bromodomain containing 2
  ENST ID: ENST00000495733
  CDS Start-End: 1573-2778
gctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagag

SEQ ID NO: 112277 - DNA, 4834 bp, Homo sapiens
  Payload ID: 1981
  Gene Symbol: BRD2
  Gene Name: bromodomain containing 2
  ENST ID: ENST00000477259
  CDS Start-End: 1550-1993
accgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 112278 - DNA, 4807 bp, Homo sapiens; identical to SEQ ID NO: 112236
  Payload ID: 1981
  Gene Symbol: BRD2
  Gene Name: bromodomain containing 2
  Uniprot ID: P25440
  ENST ID: ENST00000549126
  CDS Start-End: 1615-4020

SEQ ID NO: 112279 - DNA, 4893 bp, Homo sapiens
  Payload ID: 1981
  Gene Symbol: BRD2
  Gene Name: bromodomain containing 2
  Uniprot ID: P25440
  ENST ID: ENST00000552587
  CDS Start-End: 1702-4107
ggaccgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattg

SEQ ID NO: 112280 - DNA, 735 bp, Homo sapiens
  Payload ID: 1981
  Gene Symbol: BRD2
  Gene Name: bromodomain containing 2
  ENST ID: ENST00000496118
  CDS Start-End: 82-570
agatttgtccttcaaaccttttacagccaatgggagcgtggagggggggcgagcgggagagggccatggggggggaggggaatggccagcctcatgcctccgtacccattggagggcaaaggggttagggggcggtgtggccccccctattccattcgtcccctgggggtacagcagccgggagccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgag

SEQ ID NO: 112281 - DNA, 565 bp, Homo sapiens
  Payload ID: 1981
  Gene Symbol: BRD2
  Gene Name: bromodomain containing 2
  ENST ID: ENST00000606059
  CDS Start-End: 1-478
acccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaaggtacccactgcatggggcagatgggatgctcaggcagtgatgggagcctaggtgcaaaacaataagtctccttatgtgggcacacagcagtctttggttcttggcattttacttttataaaataatagtggaacagaa

SEQ ID NO: 112282 - DNA, 2338 bp, Homo sapiens
  Payload ID: 1981
  Gene Symbol: BRD2
  Gene Name: bromodomain containing 2
  ENST ID: ENST00000607833
  CDS Start-End: 683-2338
gagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaa

SEQ ID NO: 112283 - DNA, 5652 bp, Homo sapiens
  Payload ID: 1982
  Gene Symbol: BRD3
  Gene Name: bromodomain containing 3
  Uniprot ID: Q15059
  ENST ID: ENST00000303407
  CDS Start-End: 187-2367
ccggggccggcgagccaaagaggagccggccgcgcgggccgggaggggacggccgccggagccgcgaggccaactgtcgcctggttgggcccggaaatgggacgtcgcgctttctcagggagcgtagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggattatcataaaataattaaaaacccaatggatatggggactattaagaagagactagaaaataattattattggagtgcaagcgaatgtatgcaggacttcaacaccatgtttacaaattgttacatttataacaagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaagaaaaagggcgtgaagcggaaagcagacacaaccactcccacgacgtcggccatcactgccagccggagtgagtcgcccccgccgttgtcagaccccaagcaggccaaagtggtggcccggcgggagagtggtggccgccccatcaagcctcccaagaaggacctggaggacggcgaggtgccccagcacgcaggcaagaagggcaagctgtcggagcacctacgctactgcgacagcatcctcagggagatgctatccaagaagcacgcggcctacgcctggcccttctacaagccagtggatgccgaggccctggagctgcacgactaccacgacatcatcaagcacccgatggacctcagcaccgtgaaaaggaagatggatggccgagagtacccagacgcacagggctttgctgctgatgtccggctgatgttctcgaattgctacaaatacaatcccccagaccacgaggttgtggccatggcccggaagctccaggacgtgtttgagatgaggtttgccaagatgccagatgagcccgtggaggcaccggcgctgcctgcccccgcggcccccatggtgagcaagggcgctgagagcagccgtagcagtgaggagagctcttcggactcaggcagctcggactcggaggaggagcgggccaccaggctggcggagctgcaggagcagctgaaggccgtgcacgagcagctggccgccctgtctcaggccccagtaaacaaaccaaagaagaagaaggagaagaaggagaaggagaagaagaagaaggacaaggagaaggagaaggagaagcacaaagtgaaggccgaggaagagaagaaggccaaggtggctccgcctgccaagcaggctcagcagaagaaggctcctgccaagaaggccaacagcacgaccacggccggcagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgacgagatagaaattgactttgagactctgaaacccaccactttgcgggaactggagagatatgtcaagtcttgtttacagaaaaagcaaaggaaaccgttctcagcaagcgggaagaaacaggcagccaagtcgaaagaggagctagctcaggaaaagaagaaggagctggaaaagcgtctgcaggatgtcagcgggcagctgagcagcagcaagaagcccgcccggaaagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctgaggacagatgtgcctgcttgtggagaccaggctgggcctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaaagaagaaaagatttaaaaaaaaaaaaaaaggagactttttttgtaaggttcggcaattttctacggaagtccagcccgctgtgagtccccgcctggctagcgctgcccctgctgctgctgccgcgccacccttgggaaccacttcccgagcttatgtgtatataaatagttatttattaacatcattggtcatttttaaaaaaaagaaaataagaaaaaaccgcagaagaaatgcattcacacagtcgcagagatgcaggccttgccagtggtgtgccgggcgcgggtcctgtctggcggcggcctgtcgtctccaggtgctaactcctgccaccgcgcggtgctcacccacgtctgttcgcgcgctcgcccctgggtttgttgggttttttggtttttttctttgtggtttttttttttttttttttttgtatgaaacttggaggcttacaggtatagacagctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagacccctctttgtgttgggcagtgtcatcttgcttacaaactgtaagacacatttttttgtgtgtttgtttttgttgttgttcttttgcagcactcacgcctctgacagtcttttgggaaagagtaacacccacatacagaatttgtcacatccagagtagcactgttccttaatactggcataatgcttccaggaagtttttcttttttatatttaaaatgttacttttctgtatgatgtgcatgcaagtttaccgtaacttttcttaaactttttagtgccgtttctagtatattcctgtaaatgtcagttactgaaaatgagtccaatgtaagtagtttagcttgtttattgcaatgctggcctcaacacaacagaataaaaatggtagaaagtactctttgatgtttctggtaatcatggacccttctcctggggcatttgttttgttttcataataaaaagcaaaaaaaaaaaaaaaaaaaaa

SEQ ID NO: 112284 - DNA, 2529 bp, Homo sapiens
  Payload ID: 1982
  Gene Symbol: BRD3
  Gene Name: bromodomain containing 3
  Uniprot ID: Q15059
  ENST ID: ENST00000371834
  CDS Start-End: 323-1993
ccaggctaattaggcgcgcggtttgtttacaaacacgggctcccggcaggtgcgcgccgccccgcccgtgcgcggccggggttcgagggtggctcccgcgggcctcggggtgcccggacgggggctgcggtgctggctgcgtgcccgcttcttccatgccgtcctggggcaccggaaaatccgccgccaggcgctgtccccgacacgggctgtcgcctggttgggcccggaaatgggacgtcgcgctttctcagggagcgtagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggattatcataaaataattaaaaacccaatggatatggggactattaagaagagactagaaaataattattattggagtgcaagcgaatgtatgcaggacttcaacaccatgtttacaaattgttacatttataacaagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaagaaaaagggcgtgaagcggaaagcagacacaaccactcccacgacgtcggccatcactgccagccggagtgagtcgcccccgccgttgtcagaccccaagcaggccaaagtggtggcccggcgggagagtggtggccgccccatcaagcctcccaagaaggacctggaggacggcgaggtgccccagcacgcaggcaagaagggcaagctgtcggagcacctacgctactgcgacagcatcctcagggagatgctatccaagaagcacgcggcctacgcctggcccttctacaagccagtggatgccgaggccctggagctgcacgactaccacgacatcatcaagcacccgatggacctcagcaccgtgaaaaggaagatggatggccgagagtacccagacgcacagggctttgctgctgatgtccggctgatgttctcgaattgctacaaatacaatcccccagaccacgaggttgtggccatggcccggaagctccaggacgtgtttgagatgaggtttgccaagatgccagatgagcccgtggaggcaccggcgctgcctgcccccgcggcccccatggtgagcaagggcgctgagagcagccgtagcagtgaggagagctcttcggactcaggcagctcggactcggaggaggagcgggccaccaggctggcggagctgcaggagcagctgaaggccgtgcacgagcagctggccgccctgtctcaggccccagtaaacaaaccaaagaagaagaaggagaagaaggagaaggagaagaagaagaaggacaaggagaaggagaaggagaagcacaaagtgaaggccgaggaagagaagaaggccaaggtggctccgcctgccaagcaggctcagcagaagaaggctcctgccaagaaggccaacagcacgaccacggccggcagagatcatttcttgacctgtggagtttgagacgcctatggggtgtagagaggaacgaacctctgtaattgtttcctggccaagggctggaaaccccgcagctgggagcgacttttctaaccttggattttctgccttggggcaccactttgggaagaaagcttggtcccagagagcagcctgctgttgggaggaaggggtgtgtgcagtgggctcccacggcaggtagacggagactcaacaccacgttgctctgtctcctgccccagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgacgagatagaaattgactttgagactctgaaacccaccactttgcgggaactggagagatatgtcaagtcttgtttacagaaaaagcaaaggaaaccgttctgtaa

SEQ ID NO: 112285 - DNA, 574 bp, Homo sapiens
  Payload ID: 1982
  Gene Symbol: BRD3
  Gene Name: bromodomain containing 3
  ENST ID: ENST00000371842
  CDS Start-End: 351-574
gcactccggtgtccatggctggagctgggctccttctcagtctccggtttgaaacagtggtcaggtggttggaagtgggtggcttagagggcctgatctggccaggcgtgggatcctgacggcagcataagcaggcccccatgttgagctgtgaccgtccatcctcatgcttggaggaagctggcctgcagcctgggagccttcctttgtgccctgaccacccccacatccccaaagctgtcgcctggttgggcccggaaatgggacgtcgcgctttctcagggagcgtagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggattatcataa

SEQ ID NO: 112286 - DNA, 599 bp, Homo sapiens
  Payload ID: 1982
  Gene Symbol: BRD3
  Gene Name: bromodomain containing 3
  ENST ID: ENST00000433041
  CDS Start-End: 540-599
actgcttggcctcgctcaagggcaccacctccccgcaccgtgtttgggtctgcaaacgtccgtgttgtgccggccccacttcccctggctgtgttgggcccgcaccgtggctgtccacgcatgggtcactcttcagtacattgttgtggccaagctgtcagagcccagtagcaacgagtcgaccccacgagtgggtggttggtgggcagaaggctgccagtggctgagtcccttggcacacctgcctcccagtgtgttccccaagcccccacctgggagcaagtggcatgtgcctgagctccctccaccgcccaggccttccctcccgtgcctgagagcagtggttggagagtcgttctgagctggtcgcgcttcgcctgagcagctttcccgacagcctctcacctgggtggctgggcaatggggctgtcgcctggttgggcccggaaatgggacgtcgcgctttctcagggagcgtagaagcagccagggcctctccaagccgctgctgtgacagaaagtgagtgagctgccggaggatgtccaccgccacgacagtcgcccccgcggggatcccggcgaccccgggccctgtgaac

SEQ ID NO: 112287 - DNA, 7169 bp, Homo sapiens
  Payload ID: 1983
  Gene Symbol: BRD4
  Gene Name: bromodomain containing 4
  Uniprot ID: O60885
  ENST ID: ENST00000263377
  CDS Start-End: 223-4311
attctttggaatactactgctagaagtctgacttaagacccagcttatgggccacatggcacccagctgcttctgcagagaaggcaggccactgatgggtacagcaaagtgtggtgctgctggccaagccaaagacccgtgtaggatgactgggcctctgccccttgtgggtgttgccactgtgcttgagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacagagatggctccgaagtcaaaaaagaaggggcaccccgggagggagcagaagaagcaccatcatcaccaccatcagcagatgcagcaggccccggctcctgtgccccagcagccgcccccgcctccccagcagcccccaccgcctccacctccgcagcagcaacagcagccgccacccccgcctcccccaccctccatgccgcagcaggcagccccggcgatgaagtcctcgcccccacccttcattgccacccaggtgcccgtcctggagccccagctcccaggcagcgtctttgaccccatcggccacttcacccagcccatcctgcacctgccgcagcctgagctgccccctcacctgccccagccgcctgagcacagcactccaccccatctcaaccagcacgcagtggtctctcctccagctttgcacaacgcactaccccagcagccatcacggcccagcaaccgagccgctgccctgcctcccaagcccgcccggcccccagccgtgtcaccagccttgacccaaacacccctgctcccacagccccccatggcccaacccccccaagtgctgctggaggatgaagagccacctgccccacccctcacctccatgcagatgcagctgtacctgcagcagctgcagaaggtgcagccccctacgccgctactcccttccgtgaaggtgcagtcccagcccccaccccccctgccgcccccaccccacccctctgtgcagcagcagctgcagcagcagccgccaccacccccaccaccccagccccagcctccaccccagcagcagcatcagccccctccacggcccgtgcacttgcagcccatgcagttttccacccacatccaacagcccccgccaccccagggccagcagcccccccatccgcccccaggccagcagccacccccgccgcagcctgccaagcctcagcaagtcatccagcaccaccattcaccccggcaccacaagtcggacccctactcaaccggtcacctccgcgaagccccctccccgcttatgatacattccccccagatgtcacagttccagagcctgacccaccagtctccaccccagcaaaacgtccagcctaagaaacaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcggccggaaatgaagcctgtggatgtcgggaggcctgtgatccggcccccagagcagaacgcaccgccaccaggggcccctgacaaggacaaacagaaacaggagccgaagactccagttgcgcccaaaaaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaagtcagttccttcccacctgtgtttctgtttcgtttttttttttcttttttttctatatatattttttgttgaattctattttatttttaattctctcttctcctccagacacaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgtgaaaaaagaaaaaagctcaaaaaaatccacaaaaagacaaaacacacaaaaaaaatcctgcctatattttactcagtttcaaactttattagtctatttttaattataaaaccagaaagctacaatttcttttctttcccctccaccccccccccccccacccatttgttggcttttttgttttttaatgtcagatctgttgagttggtttttttggttttggtttttgtttttgtttttgttttttactgagaaaggaagggccaagggatgaggtgggaaccgggccctgggggcgccacagactaaggcagagactcccctacctggcgcccagccccaaccagctggccgctcctgcccatgcttttttttttttttttttttaatttttataattggagcccctggtgaggttacgcgtgccatgagaacccactctacaccacgacgctggtgcctcagtgttggccaaactctggagtcactgactggtttgactttcatacggtgaatatgcatttggtctgtactgatcatggaataaacacatctctctttttttaatgctggcgtctccctgacatttctttgtgaaccaactgttgcctaggctaggcccaggggaccccctggaccccagaccacctctgtacaggaactactgccagggattacctagcccctctcctgtgacctgtccctgtctgccctgggcgggagccacgcagactcatagcaaccaccccaagctgaagctgtgacgcagagcccggtacccatccttgtggaccctggctgaggtggagggtgtgctctagcagaaccctggccagactccagacagtattcttcccctccaccctactccatcctgtcccccctactccatcctgtccccccactcaccaaaggacttgggccacttctcccaccttgcctgcctcaacctaactcctcctttcatttaagctcagggttaaccagatactcttagatataagtctacatcccccaaaataggatcctcaccccccatgcacatacacacacattcctgtccaagaaagcccacaggtggctgctctgcctgtgtgtccacttgtgtatgtacatgccccagccacaaggcacgggtgacgcccaagaagagcccctaagatgtaagatacaagtatataatttatatgtatgcagagacaaactgattgaaacatttctagcactgtttattctcctacatcccctctttttgacctgaaaggtcctttattgtctttggatctgccaaacctccctgtgagggtgtggttcaggcatccagccagaggtccccccacttcttcgatgtccatgcccactcaggcactttctcatataccactgtgccacttcaagtgtgacgtatttaggttctttggggtttcttccatctcatcccacccactcatttttgttccttgttttgttcagacacttccccagcctgggtccaactgctgagctggatagttttctctgcagcttcctgctgaagatttaactcagccatggccttctccacacctccctgatgggtgtctctctacctgggttgtaattagaactgggatctatttaatttctccagccatttcccaacccttcccacagtactagaaatcttagtcctataccagagtaagaggtgtgtacaagcccccactgtactgtatgcacggatcgcttggccaataattatgtcagtgaatctgagacttgtattaaacactttagacatttgtagaagggaattcgtagacttttcacttacatacgaaaggtttttttttttttttgtgcagttctcattgcaaaaataaacatttgtactgagtataaagtta

SEQ ID NO: 112288 - DNA, 3240 bp, Homo sapiens
  Payload ID: 1983
  Gene Symbol: BRD4
  Gene Name: bromodomain containing 4
  Uniprot ID: O60885
  ENST ID: ENST00000360016
  CDS Start-End: 291-2675
gacgtcagtgcgctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacagctttctgcaccagtggagacttcgtgtccccagggccttccccgtatcacagtcacgtgcagtgcggccgcttcagggagatgcttcgctggtttctggtggatgtggagcagactgcagctggccagccgcatcgccagtctgctgctggccctgccatcacctgggccccagccattgcctacccctccccagagtgtgctcgttgctgtgttggctgctcctgaatctgccctaactccacacgcacctggacttgcgtgtccctcctgcagttctaactaacagtcccttcttttcaagccccgtgggtctgcacgttggaccctgggttccccattagagcccaccttctgagcagcagcctcagtgggaggtggaggcaggtagtgatgctgggtgccaggtgggagtggagaggggactgctctcctccaagtgtgcactttcctcattattctcaggggcgcagatgctcaggctggcgcaggggagaggctagggagggagccatggtgcccagaaggcctggcgaccagcccctgctgagagatggagctaacatcctgtgtttacggccaacggggttgccgctaggctggtgcagctgtcagtgagctggcgtgctgcagaccacctgagagctggccctagggtctcaggcagactggggagtggggatccacagtgggaaacctgtgttttggcagtagactcctgcatgttctcccacgggcctgtcccatccctgggattttattctaactagaaataaatgctaaccctcaataa

SEQ ID NO: 112289 - DNA, 4624 bp, Homo sapiens
  Payload ID: 1983
  Gene Symbol: BRD4
  Gene Name: bromodomain containing 4
  Uniprot ID: O60885
  ENST ID: ENST00000371835
  CDS Start-End: 223-2391
attctttggaatactactgctagaagtctgacttaagacccagcttatgggccacatggcacccagctgcttctgcagagaaggcaggccactgatgggtacagcaaagtgtggtgctgctggccaagccaaagacccgtgtaggatgactgggcctctgccccttgtgggtgttgccactgtgcttgagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatccccccaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggcca

SEQ ID NO: 112290 - DNA, 892 bp, Homo sapiens
  Payload ID: 1983
  Gene Symbol: BRD4
  Gene Name: bromodomain containing 4
  ENST ID: ENST00000597315
  CDS Start-End: 189-629
gctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagttcagaccacagatgtgattaaaatcaaccctttcaaatagaacgactctggagggagacactatacagaactcagcttttgacctctgctggtgtagtgggtaaaaatgcccagaagagatgggtagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggc

SEQ ID NO: 112291 - DNA, 1821 bp, Homo sapiens
  Payload ID: 1983
  Gene Symbol: BRD4
  Gene Name: bromodomain containing 4
  ENST ID: ENST00000594841
  CDS Start-End: 106-1821
ttttgttaagtgaggaggaggaggaggaggaggaagcggccgccgcggggtccgcggcgcgcccggcccggagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaag

SEQ ID NO: 112292 - DNA, 604 bp, Homo sapiens
  Payload ID: 1983
  Gene Symbol: BRD4
  Gene Name: bromodomain containing 4
  ENST ID: ENST00000601941
  CDS Start-End: 290-604
attttgttaagtgaggaggaggaggaggaggaggaagcggccgccgcggggtccgcggcgcgcccggcccggagatggggttccatcatgttgtccaggctcatctccaattcctgacctcaagtgacccacccttcttggcctcccgaagtgctgggattacagacgtgagccaccgtgcccggccagatgtcactttcattggttatcttcagagcctccttaaagaaactttggggtactggtagctaccagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatg

SEQ ID NO: 112293 - DNA, 726 bp, Homo sapiens
  Payload ID: 1983
  Gene Symbol: BRD4
  Gene Name: bromodomain containing 4
  ENST ID: ENST00000630599
  CDS Start-End: 286-726
cagtgcgctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagttcagaccacagatgtga

SEQ ID NO: 112294 - DNA, 5370 bp, Homo sapiens
  Payload ID: 1984
  Gene Symbol: BRD7
  Gene Name: bromodomain containing 7
  Uniprot ID: Q9NPI1
  ENST ID: ENST00000394688
  CDS Start-End: 161-2116
gagaggggcatcgcgccgcccggcgcgcgccgcccccctgcctcgcggcgcggggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatacgaacatacttgaaataattttagaatttactactgtggttctgcccctgcatacccagtgggaatgatgcccttgtatgggtaattaggcacctcccacccacccctgacaaaagcacactgggagttttatagcactgtcacatggctagtgttcttttttggttttttccgttttttaaagaaagaggagttacttagtactatagcaaagtaataagccaaataagataaactaagtcatccttgaatagatcagggaattaccagattaccaaaaggtgacatttctactttacttactgtttatctgaaatacaaaggtcaagtacccaaggagttgaactctaagtaggagaccacaagattcatggcccccttttatcagcaagctgagataaatggtgattttgctgaatcggtatagaacctgttatacacaagggaaaaaaatcaggatggagatagatagatagatagccttgttcagtgaacaaattaagtttgaaggcccttatacaatccttctataaatcacccaggcaggaagccatttgatttctattattttcctgactttgaaaattaattagtatttaggaagaacaaatagggtaaaggaaaattaattccctcaaaagacttaaaatcttatgctaaaagagtcaaattttcaagttgtttgagtctacttttaatctctagtgagttcatgaggaccacgaaaataaaataccttcagatatttgagtttttcaaattgctaatttaatgtataaaaagcagctaaacactggtactttataaaaatgaaacagcattttgaaacaaatgttacagatctataaatattcattatatagaataaaccctagttacttgcatgcaccacctcaaatcatatttctttacactgacctattatatacacaaagtatacagtggttaatgatcttctcttctgtttgtttgtttgtttgtttgttaggaaatttcctcaataagccagaaaaccttaggtattattttcacaaaagttaactcaggagaaattgtaaggaagtccttgacccatggagaaggtcactgtttgtttgtttgttagatacgtgtgtctgtcataaaacaaaatgacaccagtaattacttggtaatttaaaaacaagttcataaaaagaaaatacctgcaggtaatttttatggtcagttatattctataacctgaacactgaaaactaaaaacttttacttacaaactattattatctgagcacagcacagtgctttgctttaattggaaataaaaatgcatgagtgagtggtagtcagttatttgttaaactcccaactggggtttctgttgttactgaagaaaaaaacaaatattccaagagtacaaatatgctgacctcagagaggcccagtgcactaatgtgtttctatgttatattagcaacagaaaccttcctgacttgccaggagagcccccgccgggcagccctggtcactgctagatcttgagagcacagatttcagtatagtattcatgtgaaaccagcccttcatgtaaaaagttttggtgtgtaaaaaaggcaacttaagcgaggctaattgcccttaccagcattgttgccatgaaattcctttatacagcaagttcttctattcatactgattccacttatgtgcagcacatgagagctgccactagtctacccagcacctttgtgcaaattagaatacacctgcccttcctcgggctgataaagccacacgacacagcacaggcagacaggttcaattttcgttccctccaccgccacccccgcacttagctgtactcttaatttgcagcccggggcaactcatcccaggaccccaacaagtctggtcagtcacccaatctgcaaccctgtataatcatcttgtaaaggctcctgtatgcaagactttgtgtagaactttacggggttcatggggacacctagctaagaatccctgctatgtagggaaactgagtgcattagaaatcctggcgatgctctggtgatgaggccaccggttaagtcttccggttatgaagtccattcagaaaaagtcacgggcagtttggtcatttctcaccctgttgttacagttaggttgactttcaattccttgggaagttgaagcacagtaagacacatccccaaaacctggctttttgcatttgccttgactcacgcagtttcagagcaagaacggctcagcatttgtgagggggcgggcttcccagatccaggagcctctgcatgcacccatgcggagtagatccttctagttttgaagctctccagagttagctgtgaagactaaaggaaagaagagatgcactcacaggttgtccaagttgtctctaaacagactccattcctttctggtaagaaaagtaagatacagttgaaggacggcaggggagaacgcaaagatgtgtgagtaatcaaggaagaggtgaaaggccgcaccttactttcaaagcacctctctccagaatgcttgcctcacaagctgcctcattcaaaggcaaggctctgctgctccccgccttcttgctgtgaccacattcctcaggactctatccccacagccagctgaccccataagctgatgctagacagtagtcctccttacatgtcagtggttaaaaaggcagagcatacactggagggaagagatttatgtctagtgtctgaaaagtcattcaaaaggataaaaaccccattaatgtattcatttaaaacaaacatgccagacaaggcaaaaagtaacagtgttaattgtggtgtttttctctctacctgtttgaaaccgtttacagatgtaaaacacccctttcagcttcatttaccagaatgcctctgtgagaaatgctgtcattgccaggc

SEQ ID NO: 112295 - DNA, 2145 bp, Homo sapiens
  Payload ID: 1984
  Gene Symbol: BRD7
  Gene Name: bromodomain containing 7
  Uniprot ID: Q9NPI1
  ENST ID: ENST00000394689
  CDS Start-End: 6-1964
cggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagcagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtga

SEQ ID NO: 112296 - DNA, 2580 bp, Homo sapiens
  Payload ID: 1984
  Gene Symbol: BRD7
  Gene Name: bromodomain containing 7
  ENST ID: ENST00000562383
  CDS Start-End: 1-99
ccttcccccgtcatggaaaacaactttgtggatttgacagaagacactgaagaacctaaaaagacggatgttgctgagtgtggacctggtggaagttgaggctgcctggcccaccagggagagggagtctccaatccgtgctagacagctcagcttactcccccttggtgtctagaaaaacagacctcacttgtgcgtgcccacaggccactgaggtggaagtctgttttcatcatgtgctaaagttgcctgcctggcacctcagggaacaaagatctcaaagtcagccccgaaccagtgaacattctccagctggcctggaaactgttacagaccaggcacagagcttctggcctcccctgcgcattatggctcagtggctgcttcgagccagaatctggtgcatgtgtctgagaaatcctccagtgcaggtccaaagaagccaacatgcacagccatctgcatgcctttgggattggcgtggggcggagagtcttctcctgggcttgcttcagggaaggagactggcttcccggccttttcggaatccagcaggagccctcagttcagccccagcccctgaaacttggcagtgtccgtacagacaaagtaagtcctcagctcgcctttgcctttgacgttgatcaggccacggcattcacaagagtacccgaggccctggaggatggtgcaggtctcctcggtaacctgaaaaggaagagagacctgttgtcttcagaggcgggaagaacacctgtcatggtagggacagatagagactgcccaggcatgcagtctgccttccctggagagtgtgatagctagaaccatggctgctgggtgagacagcagctcttaagtccaagtcccctcacctctggggaagatcttttccccttagtcaactgcttccccaataggtctttacctggattttcccaagttctccagtgctttccattcggctggccacattgacagtgtttccccagatgtcatactgaggttttcgggccccaatcactccagcaatcacaggcccatggtttatgcctgaagatgatgtttacagttacccaagcgtgcaggcaaagcctcaagcttctgcccttagaggaggccagagaatccataccccagcacaggatgcggggacaaaacaactagagtgaaggctgggttgcttcccagagtcactgcgttgcagtcgggcttggggtatgaggagggcattccccggccagctctttttcagactcagaagtctgggtttgatgttaacacttgtatctgctaatctctcttttaacaaagaatactttgttaaaagtattaacaaaggcctggctttgagcgcaggcccgcaactatttaggtttagtaactttgcttccttctctatattttaaggtcacctgtttacagacaataattttggttctccattttctgtagttacgtattattaaaactctcaatggtaactatatgctaactatatgcaaaacatcagaataattgtccaactgctgagcttgtcagatcagagggatttctaaaacctttcataatagatggcgaggtgcagctgtgccacacagactgggtggactggcctagaggcaggggctccccaccccgctccatcacccgggctcaccgacgcggaggcggaaggagttgaaggagtgcctgttgatgccgtccagcttactcatcagggcgatgctgaactccaccatgacaccaatgtgggcatgctgccgctccagctcctgcgggacaggctgtgggtcagatccttgcatctccagagcccccagacctagtgggccctggcgcgccactcttgttgaggatccccaccactaaaatcctggctgagccctacaagtacctgtgcccctcccccaggacgagataagggcacaccctttaagtaaggtgacaggtcacctttaagtgaggacagtcagctgaatttcacctcttgggcttgagtacctggttctcgtgccctgaggcgacgctgagccctgcagctgccatgtacgtgctgccgatggtcttgatcttctccacgccgctgaacttgggcttcagtaggagctgcaggcaagaaggaagcggtgaagcagccgccactccatagccgcagccaggctgcccctgcttctcaggaagggtgtggggttccctccacccatcgccgcctctcgcacacacgtctcatggctgccctgccagctgagcgcatgactaagcatggtgaggacatggcccttggcggctcctgctcttcctgttgtctccgtccccacactgtctccctcttcccttccatctgtgtctgcacagagcaaacacagcattatctacacaggaatgtagattctttgtctccagcaaagaattcaacccaaactgatttcctctgtttggcttggttgatagcgtgggcttagttggaaatgaagctaaggggcctgagtctaatcttagcaagctgcccatcacagagaagatgccaacgaattatttgctgcataaaacagaatgaaaaagaaatgtgtaccttta

SEQ ID NO: 112297 - DNA, 416 bp, Homo sapiens
  Payload ID: 1984
  Gene Symbol: BRD7
  Gene Name: bromodomain containing 7
  ENST ID: ENST00000569774
  CDS Start-End: 1-330
cagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctgatgtaaaacacccctttcagcttcatttaccagaatgcctctgtgagaaatgctgtcattgccaggcccaccaggga

SEQ ID NO: 112298 - DNA, 3198 bp, Homo sapiens
  Payload ID: 1985
  Gene Symbol: BRD8
  Gene Name: bromodomain containing 8
  Uniprot ID: Q9H0E9
  ENST ID: ENST00000230901
  CDS Start-End: 17-2872
agacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaaactagc

SEQ ID NO: 112299 - DNA, 4388 bp, Homo sapiens
  Payload ID: 1985
  Gene Symbol: BRD8
  Gene Name: bromodomain containing 8
  Uniprot ID: Q9H0E9
  ENST ID: ENST00000254900
  CDS Start-End: 373-4080
aattccagtcgttcgcttctgcttgacctctgagttctaatgtgggtccgggttaccaactgtcgtggattcgcacttattttgcctgggattcttccaacttaacctttttccttgaaccttagacatttcttacctaagagcctaaaggaaatcttgaggcttcagcagccaactcctgtccttccttagcaacaatcttaacaggagtgcacagggtaactggtttagggtgcttgctttgtcttaaggggaaaaacgacatttcccaggaggcaccgcgaaccaacgccggtacactatttcccagaattccagggtttcggcccttccagaccgtctctcctcagggttggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttatgggacacgagtgggtttggctggattctgaacaagatcatcccaatgactctgagttgagcaatgactgcaggtccctcttcagctcatgggactccagtctggatcttgatgtgggcaactggagggaaactgaggatccagaggctgaggaactagaggaaagcagcccggagagagaacctagtgaactgcttgttggggatggaggcagtgaggaatctcaggaagcggcaaggaaagccagccaccagaacctcctccactttctctctgaggtagcttatttaatggagcccttgtgcatcagcagcaacgaatcaagtgaaggctgctgccctccatctggtaccagacaagaaggaagggaaattaaagctagcgaaggagaaagggagctctgcagagagactgaagagctttcagctaaaggagaccccttagtagctgaaaagccactgggagaaaatggaaagccagaggtggcttcagctccctcagttatttgtacagttcagggactactcacagagagtgaagagggggaggctcagcaagaatccaaaggggaggaccagggtgaagtatatgtgtcagagatggaagaccagcccccttcaggcgagtgtgatgatgcctttaacattaaggagactcccttggtggatacacttttcagccatgctacctcctcaaagctgactgatctaagccaggatgaccctgttcaggatcatttgctatttaagaagactctcctgccagtctggaagatgattgccagtcacaggttcagcagtccatttctgaagcctgtgtcagaaaggcaggccccagggtacaaggatgtggtgaaaagacccatggacttaactagcctgaagagaaatctctctaagggtcggattcgcaccatggcccaattcctgcgagacctgatgctgatgttccaaaatgctgtaatgtacaatgactctgatcatcatgtataccatatggctgtggagatgcggcaagaagtcctggagcagattcaggtactgaatatctggttagacaaaagaaaaggctcaagtagtctggaaggagaaccagctaacccagtggatgatggaaaacctgttttctaacctggagctgctatcctgactttttctagagtttgaatctctcccggaactctgacctagagaggatcctggtacttctttgccatgtcctcattttcttttccaacaagaataataccttaactcacaaccaacgagtcaaagatgcatgtggacataatataaagaaaaaaaggggaagctgaggtttggatttatgccataaatgttgcccacatctttgttccatcggcttgatttaaagacaattccattagatcttttctaagccttttactctataaataaatgtatttacacaataggaa

SEQ ID NO: 112300 - DNA, 2982 bp, Homo sapiens
  Payload ID: 1985
  Gene Symbol: BRD8
  Gene Name: bromodomain containing 8
  ENST ID: ENST00000402931
  CDS Start-End: 20-2656
tggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaaactagc

SEQ ID NO: 112301 - DNA, 1011 bp, Homo sapiens
  Payload ID: 1985
  Gene Symbol: BRD8
  Gene Name: bromodomain containing 8
  ENST ID: ENST00000427976
  CDS Start-End: 1-1011
gatcttgatgtgggcaactggagggaaactgaggatccagaggctgaggaactagaggaaagcagcccggagagagaacctagtgaactgcttgttggggatggaggcagtgaggaatctcaggaagcggcaaggaaagccagccaccagaacctcctccactttctctctgaggtagcttatttaatggagcccttgtgcatcagcagcaacgaatcaagtgaaggctgctgccctccatctggtaccagacaagaaggaagggaaattaaagctagcgaaggagaaagggagctctgcagagagactgaagagctttcagctaaaggagaccccttagtagctgaaaagccactgggagaaaatggaaagccagaggtggcttcagctccctcagttatttgtacagttcagggactactcacagagagtgaagagggggaggctcagcaagaatccaaaggggaggaccagggtgaagtatatgtgtcagagatggaagaccagcccccttcaggcgagtgtgatgatgcctttaacattaaggagactcccttggtggatacacttttcagccatgctacctcctcaaagctgactgatctaagccaggatgaccctgttcaggatcatttgctatttaagaagactctcctgccagtctggaagatgattgccagtcacaggttcagcagtccatttctgaagcctgtgtcagaaaggcaggccccagggtacaaggatgtggtgaaaagacccatggacttaactagcctgaagagaaatctctctaagggtcggattcgcaccatggcccaattcctgcgagacctgatgctgatgttccaaaatgctgtaatgtacaatgactctgatcatcatgtataccatatggctgtggagatgcggcaagaagtcctggagcagattcaggtactgtatgcagatacctgtagcctctggaatcttgatttcagaacgcctatgagaataaaggtgatttcgaggtga

SEQ ID NO: 112302 - DNA, 2967 bp, Homo sapiens
  Payload ID: 1985
  Gene Symbol: BRD8
  Gene Name: bromodomain containing 8
  Uniprot ID: Q9H0E9
  ENST ID: ENST00000411594
  CDS Start-End: 56-2656
gggtttcggcccttccagaccgtctctcctcagggttggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 112303 - DNA, 590 bp, Homo sapiens
  Payload ID: 1985
  Gene Symbol: BRD8
  Gene Name: bromodomain containing 8
  ENST ID: ENST00000450756
  CDS Start-End: 15-218
acttcggggccaagatggcgacgggaacgggcaaacacaagctgctaagcactggccccacagagccatggtccatccgagagaagctatgtttagcatcttctgtcatgagaagtggcgatcaaaattggctggagtgcagtggcgcgatttgggctcactgcagcctcttgacttcctgggctcaagggatcctcctacctcagctgcccaagtagctgggaccacaggccgcagggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctg

SEQ ID NO: 112304 - DNA, 3005 bp, Homo sapiens
  Payload ID: 1985
  Gene Symbol: BRD8
  Gene Name: bromodomain containing 8
  ENST ID: ENST00000454473
  CDS Start-End: 1-2679
ggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaaactagc

SEQ ID NO: 112305 - DNA, 2899 bp, Homo sapiens
  Payload ID: 1985
  Gene Symbol: BRD8
  Gene Name: bromodomain containing 8
  ENST ID: ENST00000441656
  CDS Start-End: 1-2573
aacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaaactagc

SEQ ID NO: 112306 - DNA, 956 bp, Homo sapiens
  Payload ID: 1985
  Gene Symbol: BRD8
  Gene Name: bromodomain containing 8
  ENST ID: ENST00000432618
  CDS Start-End: 340-579
gttctaatgtgggtccgggttaccaactgtcgtggattcgcacttattttgcctgggattcttccaacttaacctttttccttgaaccttagacatttcttacctaagagcctaaaggaaatcttgaggcttcagcagccaactcctgtccttccttagcaacaatcttaacaggagtgcacagggtaactggtttagggtgcttgctttgtcttaaggggaaaaacgacatttcccaggaggcaccgcgaaccaacgccggtacactatttcccagaattccagggtttcggcccttccagaccgtctctcctcagggttggagacttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaagtgagtacaaagccagacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttg

SEQ ID NO: 112307 - DNA, 2912 bp, Homo sapiens
  Payload ID: 1985
  Gene Symbol: BRD8
  Gene Name: bromodomain containing 8
  ENST ID: ENST00000418329
  CDS Start-End: 1-2586
ggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaaactagc

SEQ ID NO: 112308 - DNA, 561 bp, Homo sapiens
  Payload ID: 1985
  Gene Symbol: BRD8
  Gene Name: bromodomain containing 8
  ENST ID: ENST00000453824
  CDS Start-End: 1-561
aaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcagtgagtcaacccgacaactgtgttcccatggaggctgtgggggatccacatactgtgactgtttccatggacagcagtgaaatatccatgatcatcaattctatcaaagaa

SEQ ID NO: 112309 - DNA, 432 bp, Homo sapiens
  Payload ID: 1985
  Gene Symbol: BRD8
  Gene Name: bromodomain containing 8
  ENST ID: ENST00000430331
  CDS Start-End: 65-432
agaattccagggtttcggcccttccagaccgtctctcctcagggttggagacttcggggccaagatggcgacgggaacgggcaaacacaagctgctaagcactggccccacagagccatggtccatccgagagaagctatgtttagcatcttctgtcatgagaagtggcgatcaaaattgggggtggtcttactctgtcacccaggctggagtgcagtggcgcgatttgggctcactgcagcctcttgacttcctgggctcaagggatcctcctacctcagctgcccaagtagctgggaccacaggccgcagggtatcagttagcagagcaatcaagccctttgcagaacctggccgccctccagactggttctctcaaaaacattgtgcttcccagtactcggagcttttagagaccactgagacaccaaa

SEQ ID NO: 112310 - DNA, 754 bp, Homo sapiens
  Payload ID: 1985
  Gene Symbol: BRD8
  Gene Name: bromodomain containing 8
  ENST ID: ENST00000428808
  CDS Start-End: 16-135
gacttcggggccaagatggcgacgggaacgggcaaacacaagctgctaagcactggccccacagagccatggtccatccgagagaagctatgtttagcatcttctgtcatgagaagtggcgatcaaaattggtaagggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtcaatgagagtgaaatggctgtggcttctggccacctgaacagtacaggtgtcctcctggaggtaggcggggtccttcccatgatacatgg

SEQ ID NO: 112311 - DNA, 745 bp, Homo sapiens
  Payload ID: 1985
  Gene Symbol: BRD8
  Gene Name: bromodomain containing 8
  ENST ID: ENST00000472478
  CDS Start-End: 1-109
gatcagtgctaaaagtcttcgagggagagattctacccgcaaacaggatgcttcagagaaggacagtgtcccaatgggctctcctgccttccttctctctctcttttgactctggatcccccaagcaaagcatttggctggctattgcaaggctggttaataggatcttttatctattgaagacagcaaaatattgcacaagaggaaggagctgggctgcagggagagagcagcagatggaaagaagccttctaattgtcctgatctcatggaaaaccactgtcaggaggtgctagggaactagtgccagggtcagtctgcaggaaaggcctttcttatagggaccaacagttggacaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactgaaaaaaaaaactagc

SEQ ID NO: 112312 - DNA, 586 bp, Homo sapiens
  Payload ID: 1985
  Gene Symbol: BRD8
  Gene Name: bromodomain containing 8
  ENST ID: ENST00000511898
  CDS Start-End: 1-586
ggatcaaaggctcccagcatagatgggaaggaagaattagatctggctgagaagatggatattgctgtgtcttacacaggtgaagagctggattttgagactgttggagacatcattgccatcattgaggacaaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggt

SEQ ID NO: 112313 - DNA, 1363 bp, Homo sapiens
  Payload ID: 1985
  Gene Symbol: BRD8
  Gene Name: bromodomain containing 8
  ENST ID: ENST00000506167
  CDS Start-End: 1-879
catactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaagggtcagagttactctcgagcaaggggaaagaaggaacgcctcttagcttagtcttaagatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctg

SEQ ID NO: 112314 - DNA, 2876 bp, Homo sapiens
  Payload ID: 1985
  Gene Symbol: BRD8
  Gene Name: bromodomain containing 8
  ENST ID: ENST00000512140
  CDS Start-End: 17-163
agacttcggggccaagatggcgacgggaacgggcaaacacaagctgctaagcactggccccacagagccatggtccatccgagagaagctatgtttagcatcttctgtcatgagaagtggcgatcaaaattgcattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtg

SEQ ID NO: 112315 - DNA, 3477 bp, Homo sapiens
  Payload ID: 1986
  Gene Symbol: BRD9
  Gene Name: bromodomain containing 9
  ENST ID: ENST00000490814
  CDS Start-End: 46-318
gtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaagggtttgctgactcacagaaacacaacagaacagacttaaaggagagtgggagaaaaggaaactcgatgagaggatcaggcagcgcctgagggtagatgttaagagcactccatgcccgaaagccctctgtattccctgcttcgggccccagtctggccattcctagcaacaaagcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaaggagacgttctagacccagtgtcttcagtggaaacagagcacaggctgtctgcagtctcaggcttcctagcagccctgataagagaagtagagcaatgcagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggtttctttcagggcctgccatctatcacgtgatgctgtactaaagtcggatcggaatttggtgtcttattaccacggagtctgctttgtcaaccttcagatttctgttttaaagttaatgctggtcagctgtgcctgaattccaaaagaggggataatgagatgtttccctgacttctgtgagtcactctaggaaattcatagagctcaagtctggtcttctgggaaccccatttgatagctggttagtcggaagcacagaccacagcctggggctttcagttggcatcagccggtggggccatcctggagactgtgccctcacctgggaggctgccggtgcagcgcccccgagctgttctgacctccagcagcatttgtggtgcctggatccatgggtcccactgctttgcgtggtgacgttccacctgtctctgctggctctgttcaggcacttatggccgtgatttattataggggaagggtgccaacagcagcagagggacaagagtgacatccaaggaaacccagcgtgaggcccagatccactcccagcagaggcacatgggacacgcttaattcccaggagtgagctgtgacaacacacgtgaaatgcccaccagggaagcccgtcagaggcttggtgctcggggtcacagggcacccccttgccagggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 112316 - DNA, 3170 bp, Homo sapiens
  Payload ID: 1986
  Gene Symbol: BRD9
  Gene Name: bromodomain containing 9
  ENST ID: ENST00000489816
  CDS Start-End: 539-811
gggcaccgggcgaggtcctggccacgagggaggggttctgggcacgcgggagggggtcctgggatttcgggcagggaaccgggcacacgtgaggggtcctgggtaggcgcttacgttcctggtagagggttctgggttcgaggctgcaagcccactcaccccggtcctggagactagggaagcatctgtgctggcttttgtgtggagctcagggagaagctgggctgccctttctcccgcctttccctccctctcccttgctcccgcagcagctccatgggtgtcagcgggcagcacgggcgcctgcaggaagtcaggcgagggtgaaccgaagtgctgggggtttctaggagggagatcgggctccggggttccaggtccctcttaatccatcttcttgaacgagtaatgtgaacaacatcccacagggcctctgattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggcctgccatctatcacgtgatgctgtactaaagtcggatcggaatttggtgtcttattaccacggagtctgctttgtcaaccttcagatttctgttttaaagttaatgctggtcagctgtgcctgaattccaaaagaggggataatgagggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaac

SEQ ID NO: 112317 - DNA, 2156 bp, Homo sapiens
  Payload ID: 1986
  Gene Symbol: BRD9
  Gene Name: bromodomain containing 9
  Uniprot ID: Q9H8M2
  ENST ID: ENST00000467963
  CDS Start-End: 168-1961
ctgccgcggccccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcat

SEQ ID NO: 112318 - DNA, 2120 bp, Homo sapiens
  Payload ID: 1986
  Gene Symbol: BRD9
  Gene Name: bromodomain containing 9
  Uniprot ID: Q9H8M2
  ENST ID: ENST00000483173
  CDS Start-End: 141-1775
tccgggcacgcggacgggggtcctgggcaccgggcgagattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagt

SEQ ID NO: 112319 - DNA, 2843 bp, Homo sapiens
  Payload ID: 1986
  Gene Symbol: BRD9
  Gene Name: bromodomain containing 9
  ENST ID: ENST00000495265
  CDS Start-End: 298-570
tttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaagagcggctgttagctttgaagcgcagcatgtcgtttatgcaggacatggatttttctcagcaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 112320 - DNA, 1417 bp, Homo sapiens
  Payload ID: 1986
  Gene Symbol: BRD9
  Gene Name: bromodomain containing 9
  ENST ID: ENST00000466684
  CDS Start-End: 154-426
acgggggaggagttccgggcacgcggacgggggtcctgggcaccgggcgagattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagc

SEQ ID NO: 112321 - DNA, 753 bp, Homo sapiens
  Payload ID: 1986
  Gene Symbol: BRD9
  Gene Name: bromodomain containing 9
  ENST ID: ENST00000487688
  CDS Start-End: 205-477
gggcaccgggcgaggtcctggccacgagggaggggttctgggcacgcgggagggggtcctgggatttcgggcagggaaccgggcacacgtgaggggtcctggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaata

SEQ ID NO: 112322 - DNA, 1139 bp, Homo sapiens
  Payload ID: 1986
  Gene Symbol: BRD9
  Gene Name: bromodomain containing 9
  ENST ID: ENST00000489093
  CDS Start-End: 464-1139
ggctggaggaggggagggggtgttccgttggtagcaaaacgcgaaccgctgaggcccgcagactcagttccaggatcctgggtgtgctgttcctcagcagaccctgccagggtctctgtgaggagggagcctggcatgaggaggatctcggagggggtttcccttagttctgtccctcccctgagaactgcgaggggattgggcagacctgtccggatcccgcctactcctgcctttctcactcccttgactctgccgcccaggaagagaagaagcggaagcgagagagggagcactgtgacacggagggagaggctgacgactttgatcctgggaagaaggtggaggtggagccgcccccagatcggccagtccgagcgtgccggacacagccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaagagcggctgttagctttgaagcgcagcatgtcgtttatgcaggacatggatttttctcagcaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggca

SEQ ID NO: 112323 - DNA, 546 bp, Homo sapiens
  Payload ID: 1986
  Gene Symbol: BRD9
  Gene Name: bromodomain containing 9
  ENST ID: ENST00000518251
  CDS Start-End: 1-372
tcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggcctgccatctatcacgtgatgctgtactaaagtcggatcggaatttggtgtcttattaccacggagtctgctttgtcaaccttcagatttctgttttaaagttaatgctggtcagctgtgcctgaattccaaaagaggggataatgaggggaagggtgccaacagcagcagagggacaagagtgacatccaaggaaacccagcg

SEQ ID NO: 112324 - DNA, 861 bp, Homo sapiens
  Payload ID: 1986
  Gene Symbol: BRD9
  Gene Name: bromodomain containing 9
  ENST ID: ENST00000519112
  CDS Start-End: 1-524
tcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggtttctttcagggcctgccatctatcacgtgatgctgtactaaagtcggatcggaatttggtgtcttattaccacggagtctgctttgtcaaccttcagatttctgttttaaagttaatgctggtcagctgtgcctgaattccaaaagaggggataatgagggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttat

SEQ ID NO: 112325 - DNA, 580 bp, Homo sapiens
  Payload ID: 1986
  Gene Symbol: BRD9
  Gene Name: bromodomain containing 9
  ENST ID: ENST00000523139
  CDS Start-End: 1-277
gtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggcctgccatctatcacgtgatgctgtactaaagtcggatcggaatttggtgtcttattaccacggagtctgctttgtcaaccttcagatttctgttttaaagttaatgctggtcagctgtgcctgaattccaaaagaggggataatgagatgtttccctgacttctgtgagtcactctaggaaattcatagagctcaagtctggtcttctgggaaccccatttgatagctggggaagggtgccaacagcagcagagggacaagagtgacatccaaggaaacccagcgtgaggcccagatccactcccagcagaggcacatgggacacgcttaat

SEQ ID NO: 112326 - DNA, 689 bp, Homo sapiens
  Payload ID: 1986
  Gene Symbol: BRD9
  Gene Name: bromodomain containing 9
  ENST ID: ENST00000518250
  CDS Start-End: 1-218
gcagcagctctgttctggagttcatgtcgatgaagtcctatcccgacgtttctgtggatatctccatgctcagctctctggtttctttcagggcctgccatctatcacgtgatgctgtactaaagtcggatcggaatttggtgtcttattaccacggagtctgctttgtcaaccttcagatttctgttttaaagttaatgctggtcagctgtgcctgaattccaaaagaggggataatgagatgtttccctgacttctgtgagtcactctaggaaattcatagagctcaagtctggtcttctgggaaccccatttgatagctggggaagggtgccaacagcagcagagggacaagagtgacatccaaggaaacccagcgtgaggcccagatccactcccagcagaggcacatgggacacgcttaattcccaggagtgagctgtgacaacacacgtgaaatgcccaccagggaagcccgtcagaggcttggtgctcggggtcacagggcacccccttgccagggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgg

SEQ ID NO: 112327 - DNA, 9688 bp, Homo sapiens
  Payload ID: 1987
  Gene Symbol: BPTF
  Gene Name: bromodomain PHD finger transcription factor
  Uniprot ID: Q12830
  ENST ID: ENST00000306378
  CDS Start-End: 61-8823
gccccccctgcgcccgcccctcccccttcgctttccttctccccccgcctcggctccgacatgaggggccggcggggcaggccgcccaagcagcccgcggctcccgctgcggagcgctgcgccccggccccgccgccaccgccgccgccgcccacgtccggacccatcggggggctccgctcgcggcaccgcggcagcagccggggcaggtgggccgccgcccaggctgaggtggcgcccaagacgcggctgagctcgcccagggggggcagcagtagccggaggaagccgccgccgccgccgccggccccccccagcaccagcgccccgggccggggggggcgaggaggcgggggcggcaggacggggggcgggggcggcggcggccacctggcccggaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtacagtcttcaactcaaactctttcatcaggacaaactttaaatcaagttactgtttcatccccatcccgtcctcagctacaaatacagcagccacagccccaagtcattgctgtgcctcagctgcaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaatgtggttacagtgcaggcagccagtgtgcaagagcagttgcaaagggttcagcaactcagggatcagcagcaaaagaagaaacagcaacagatagaaattaagcgtgaacacaccctccaagcttctaatcaaagtgaaatcattcagaaacaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaattattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaaatgagtaaaatctatttgaaggtatcttgtttgtaaacatttgtcagattctaatttttttcttttgtattaaaattcaactatggatgtatatgaaacaaaataaatggagataatttttctcccaca

SEQ ID NO: 112328 - DNA, 11292 bp, Homo sapiens
  Payload ID: 1987
  Gene Symbol: BPTF
  Gene Name: bromodomain PHD finger transcription factor
  Uniprot ID: Q12830
  ENST ID: ENST00000321892
  CDS Start-End: 62-9202
cgccccccctgcgcccgcccctcccccttcgctttccttctccccccgcctcggctccgacatgaggggccggcggggcaggccgcccaagcagcccgcggctcccgctgcggagcgctgcgccccggccccgccgccaccgccgccgccgcccacgtccggacccatcggggggctccgctcgcggcaccgcggcagcagccggggcaggtgggccgccgcccaggctgaggtggcgcccaagacgcggctgagctcgcccagggggggcagcagtagccggaggaagccgccgccgccgccgccggccccccccagcaccagcgccccgggccggggggggcgaggaggcgggggcggcaggacggggggcgggggcggcggcggccacctggcccggaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccagaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagatagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtacagtcttcaactcaaactctttcatcaggacaaactttaaatcaagttactgtttcatccccatcccgtcctcagctacaaatacagcagccacagccccaagtcattgctgtgcctcagctgcaacaacaagtccaggttctctctcagatccagtcacaggttgtggctcagatacaggctcagcaaagtggtgtgccccagcaaatcaaactccagttacctatccaaattcagcaaagcagtgctgtgcagactcaccagattcagaatgtggttacagtgcaggcagccagtgtgcaagagcagttgcaaagggttcagcaactcagggatcagcagcaaaagaagaaacagcaacagatagaaattaagcgtgaacacaccctccaagcttctaatcaaagtgaaatcattcagaaacaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaattattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaaatgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgcgctaatgattatctgtaagcctttgtggggagggaggcctgcaaggtcatgaaaggcagaagagtctaattgtgcctggatttctccaggacagcagtggcccctcgttttatcattcccagtccattgtcatcacgtcagagaaaaatcttcaggggtgctaatcctgttgcatcagttgatcatactaacgagaacggtaatgcgacaagatacacattgccttcatctgtacattctgtgataccaggcaaattaccaattacacacagctacttatattttatgaagggcattttttagatgacctcatcctctgtgttatttgttgattgggtttgttttctgtttgttggtttgtttgtttcttccacgtaaggaaaagtagtgtaaacagtagcgagaaaatggaaaccacagaggaagatgtattttgcatgtttttcctttcagtgttcttacacgttgtatcactgcattgtggtaatagcttctataaaatctgccatagttggattatgcagctttgcaaaaatttttactagattttgcactaactcatattagctttgtcctaccaacttctggaatttatctaattattgtttttcaaagtttctttccttttaatgtttccctgctatgcaaaacctttcccagacctcagtttcttaaaagaaagatgttgctacagttcccgattctttcttattacaggctcaggtgtacaggttattctgggttaattttatctaatgaagcccattcctttttgtacataaagatgtcacttaaacttatgcttacaaactaaagactaatcgctcaatatgaaaacatgaaaaaatttttgcttaaagtattaagatggaagtagttaaatatgggttattttgtccttttacttttttaaaaaatgttacatattgtatgcactgtgctgatgcaagaattctacattttaatgagttataaaattattctgcatctcatcacgtcacagtatttctgtactatttattcatatatataaatatatatgggcttaatcatttaaaatttgttgcagcaagaactttcctacctgtaggcaatagattgctatgtttttaacaaattgtggcaaattctaaacagcaattcttttgtacgtaataggacatttcatcctagaaaaataaagtaatgtttttgacattgga

SEQ ID NO: 112329 - DNA, 2627 bp, Homo sapiens
  Payload ID: 1987
  Gene Symbol: BPTF
  Gene Name: bromodomain PHD finger transcription factor
  ENST ID: ENST00000335221
  CDS Start-End: 31-2463
gagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccagaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagatagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaagagaagaaacaggaagaagaagaaacgatgcagcaagcg

SEQ ID NO: 112330 - DNA, 4041 bp, Homo sapiens
  Payload ID: 1987
  Gene Symbol: BPTF
  Gene Name: bromodomain PHD finger transcription factor
  ENST ID: ENST00000342579
  CDS Start-End: 1-1951
gactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaagttctatattggctgtgatctttgtactaactggtatcatggagaatgtgttggcatcacagaaaaggaggctaagaaaatggatgtgtacatctgtaatgattgtaaacgggcacaagagggcagcagtgaggaattgtactgtatctgcagaacaccttatgatgagtcacaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaaagcaagaaaaaaagatactatggggtcaagtgtaactccatggaaatgccacgtctgctcttcagtgaagaagctggtttagagtctcacagaaaacttttgactgtatttatttattgttgcaaaaaagacgcttttttattgctgccctcatttgtcagctaattattttttcttataaaatccagccccggttacatataatcatctgtatcttatcatgattcctgtaggtaaaagtacaagacgacctctagatgtcttttctttctatgaaaggagctgctatgtacacatgtgcacacacacacaactgggaatcaacaatgagtttattgttcatggtagattaaaattaagcttgcataaaggttgggctaagtggtcctggactacagactctgttgccttgaatataacagtacaatttgtcaattactctgcaccaggctaaaatgagtaaaatctatttgaaggtatcttgtttgtaaacatttgtcagattctaatttttttcttttgtattaaaattcaactatggatgtatatgaaacaaaataaatggagataatttttctcccacagacagaggtgtctttgaatgtgcgctaatgattatctgtaagcctttgtggggagggaggcctgcaaggtcatgaaaggcagaagagtctaattgtgcctggatttctccaggacagcagtggcccctcgttttatcattcccagtccattgtcatcacgtcagagaaaaatcttcaggggtgctaatcctgttgcatcagttgatcatactaacgagaacggtaatgcgacaagatacacattgccttcatctgtacattctgtgataccaggcaaattaccaattacacacagctacttatattttatgaagggcattttttagatgacctcatcctctgtgttatttgttgattgggtttgttttctgtttgttggtttgtttgtttcttccacgtaaggaaaagtagtgtaaacagtagcgagaaaatggaaaccacagaggaagatgtattttgcatgtttttcctttcagtgttcttacacgttgtatcactgcattgtggtaatagcttctataaaatctgccatagttggattatgcagctttgcaaaaatttttactagattttgcactaactcatattagctttgtcctaccaacttctggaatttatctaattattgtttttcaaagtttctttccttttaatgtttccctgctatgcaaaacctttcccagacctcagtttcttaaaagaaagatgttgctacagttcccgattctttcttattacaggctcaggtgtacaggttattctgggttaattttatctaatgaagcccattcctttttgtacataaagatgtcacttaaacttatgcttacaaactaaagactaatcgctcaatatgaaaacatgaaaaaatttttgcttaaagtattaagatggaagtagttaaatatgggttattttgtccttttacttttttaaaaaatgttacatattgtatgcactgtgctgatgcaagaattctacattttaatgagttataaaattattctgcatctcatcacgtcacagtatttctgtactatttattcatatatataaatatatatgggcttaatcatttaaaatttgttgcagcaagaactttcctacctgtaggcaatagattgctatgtttttaacaaattgtggcaaattctaaacagcaattcttttgtacgtaataggacatttcatcctagaaaaataaagtaatgtttttgacattgga

SEQ ID NO: 112331 - DNA, 8295 bp, Homo sapiens
  Payload ID: 1987
  Gene Symbol: BPTF
  Gene Name: bromodomain PHD finger transcription factor
  ENST ID: ENST00000424123
  CDS Start-End: 1-8295
atggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccagaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagatagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcaggtctcataacaacaaactgcagtctacagcttcttaa

SEQ ID NO: 112332 - DNA, 7573 bp, Homo sapiens
  Payload ID: 1987
  Gene Symbol: BPTF
  Gene Name: bromodomain PHD finger transcription factor
  ENST ID: ENST00000544778
  CDS Start-End: 202-7573
aaacaagatggcggctgaaggcgatccggagtggggccccagcaattcggattgagccttctccctccacccgcttccgtcggccgggcccctcccgcccggccccgcgggcctccccacccggccccggcgctccccaccgccccccctgcgcccgcccctcccccttcgctttccttctccccccgcctcggctccgacatgaggggccggcggggcaggccgcccaagcagcccgcggctcccgctgcggagcgctgcgccccggccccgccgccaccgccgccgccgcccacgtccggacccatcggggggctccgctcgcggcaccgcggcagcagccggggcaggtgggccgccgcccaggctgaggtggcgcccaagacgcggctgagctcgcccagggggggcagcagtagccggaggaagccgccgccgccgccgccggccccccccagcaccagcgccccgggccggggggggcgaggaggcgggggcggcaggacggggggcgggggcggcggcggccacctggcccggaccaccgcggcccggagggccgtcaacaaagtggtgtacgatgaccacgagagcgaggaggaggaggaagaggaggacatggtctccgaggaggaggaggaggaggacggcgacgccgaggagacccaggattctgaggacgacgaggaggatgagatggaagaggacgacgatgactccgattatccggaggagatggaagacgacgacgacgacgccagttactgcacggaaagcagcttcaggagccatagtacctacagcagcactccaggtaggcgaaaaccaagagtacatcggcctcgttctcctatattggaagaaaaagacatcccgccccttgaatttcccaagtcctctgaggatttaatggtgcctaatgagcatataatgaatgtcattgccatttacgaggtactgcggaactttggcactgttttgagattatctccttttcgctttgaggacttttgtgcagctctggtgagccaagagcagtgcacactcatggcagagatgcatgttgtgcttttgaaagcagttctgcgtgaagaagacacttccaatactacctttggacctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatgaagaaattttggaatccataagagccaaaaagggagacattgataatgttaaaagcccagaagaaacagaaaaagacaagaatgagactgagaatgactctaaagatgctgagaaaaacagagaagaatttgaagaccagtcccttgaaaaagacagtgacgacaaaacaccagatgatgaccctgagcaaggaaaatctgaggagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtactggtagttaactctcaaggagaaatttcacggttgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtgcagttaaaccagttgtgatgctaccaatatggcgagaatctttaggacataccaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtttggaaacaaaaaggtgaagagtacagagtgacaggatatggtggttggagctggattagtaaaactcatgtttataggtttgttcctaaattgccaggcaatactaatgtgaattacagaaagtcgttagaaggaaccaaaaataatatggatgaaaatatggatgagtcagataaaagaaaatgttcacgaagtccaaaaaaaataaaaatagagcctgattctgaaaaagatgaggtaaaaggttcagatgctgcaaaaggagcagaccaaaatgaaatggatatctcaaagattactgagaagaaggaccaagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccaccacgggaggcacactggttacatctatgactgtgagcaaagagtattccacacgagacaaagtgaaactgatgaaattttcaagaccaaagaagactcgttcaggtacagctctgccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacagaaacatccgaaactgaaatcacaacaacagaaataattaagaggagagatgttggtccttatggcattcgatctgaatattgtatcaggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaacttcagcaacgtccacttcaaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaac

SEQ ID NO: 112333 - DNA, 409 bp, Homo sapiens
  Payload ID: 1987
  Gene Symbol: BPTF
  Gene Name: bromodomain PHD finger transcription factor
  ENST ID: ENST00000544491
  CDS Start-End: 1-409
agatgctgagaaaaacagagaagaatttgaagaccagtcccttgaaaaagacagtgacgacaaaacaccagatgatgaccctgagcaaggaaaatctgaggaagaacctaacaagacatgtgagagcagtaacactagtgctaccactacctccatccagcctaatctggaaaacagtaacagcagcagtgaactaaattcttcccagagtgaatctgctaaggcagctgatgatcctgaaaatggagaaagagaatctcatacacctgtctctattcaggaagagatagtaggtgatttcaaatcggagaagtccaacggggagctaagtgaatctcctggagctggaaaaggagcatctggctcaactcgaatcatcaccagattgcggaatccagatagcaaactt

SEQ ID NO: 112334 - DNA, 1951 bp, Homo sapiens
  Payload ID: 1987
  Gene Symbol: BPTF
  Gene Name: bromodomain PHD finger transcription factor
  ENST ID: ENST00000580465
  CDS Start-End: 1-1453
aaatatacagtcttcagcctcacaaccccctcgcccccaacaaggacaagtgaagctcaccatggctcaacttactcagttaacacagggccacggtggcaatcaaggtttgacagtagtaattcaaggacaaggtcaaactactggacagttgcagttgatacctcaaggggtgactgtactcccaggcccaggccagcagctaatgcaagctgcaatgccaaatggtactgttcagcgattcctctttaccccattggcaacaacagccaccacagccagcaccaccaccaccactgtttccacgacagcagcaggtacaggtgaacaaaggcagagtaaactgtcaccccagatgcaggtacatcaagacaaaaccctgccaccagctcagtcatcaagtgtgggtccagcagaagcccagccacagactgctcagccttcagctcagccccagccccaaacccagccccagtccccagctcagcctgaagttcagactcagcctgaagttcagacccaaacaactgtttcatcccatgtcccttctgaagcacaacccacccacgcacagtcatccaagccccaagttgcagcacagtctcagcctcaaagtaatgtccaaggacagtctcctgttcgtgtccaaagtccatcacagactcgaatacgtccatcaactccatcccaactgtctcctggacaacaatcccaggttcagactacaacctcacaaccgattccaattcaaccacatacatctcttcagataccttcccaaggccagccacagtcacaaccccaggtggtgatgaagcataatgctgtaatagaacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaagtgagtagatctttttgagctctagttttttgtcttgaaagtttagctattaaattggattttgaagaaaatgaatattttgggagtgatataaatgaaaatattaaatttaagagtaatgtttcatccatggtcttgcatgtgatattcttaccattgacgctagtaaagtaaaatttgctatttcacgtgtttgtgattgtcctttgttatattcttttctgtcaaaaacaagctttctgttgctcctttgctttctcttcttccctctgaattaactccaaatcagtgagtaattgatgtctggagaaggaggtgtattactgttgcccaaaatggagagcatcctttctgggatctgttcaaagccctgcgaatacatgaaatcctggaaaccagttgaacatgaatggtcagaggttttgaatttgagtggttcggtttcttaattgttttattttaagcagttgtttttttttgtattaaaatactgcaactcata

SEQ ID NO: 112335 - DNA, 594 bp, Homo sapiens
  Payload ID: 1987
  Gene Symbol: BPTF
  Gene Name: bromodomain PHD finger transcription factor
  ENST ID: ENST00000577837
  CDS Start-End: 1-194
gacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcagggtgaatgaaagaacatggctgcttctcccagactgactgaccttggcatccgcataaagcatcattgttttcaaaaatgaagggtgcttaattgttcccttttttctatattctgtaggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaa

SEQ ID NO: 112336 - DNA, 464 bp, Homo sapiens
  Payload ID: 1987
  Gene Symbol: BPTF
  Gene Name: bromodomain PHD finger transcription factor
  ENST ID: ENST00000583990
  CDS Start-End: 1-208
gctcacgccactaacagagaaggattatgaggggttgaagagggtgctccgttccttacaggcccataagatggcctggcctttccttgaaccagtagaccctaatgatgcaccagattattatggtgttattaaggaacctatgggtctcataacaacaaactgcagtctacagcttcttaaagttcagcgtgttaacctaacataaaacacagcaagaatctggttgtctgaactattttaaattaaggagccagatgtttttagtcaggctatcctgacaagacttgacctaaacttcgtttttattggtcataacagtccaattatattcttggccaattttgtccaacggacaagaaaaaagcaaagtcaacgacaccattatcttgtcaagatcagatggttttactattgtggcagaagcgagaaaactttgtttattgaaaaaaaaagaaaaagaa

SEQ ID NO: 112337 - DNA, 1015 bp, Homo sapiens
  Payload ID: 1987
  Gene Symbol: BPTF
  Gene Name: bromodomain PHD finger transcription factor
  ENST ID: ENST00000582467
  CDS Start-End: 1-1015
caggaaaatcatttgtcccattggagttccagaaacaccaaaagaaacgcctacacctcagaggaaaggccttcgatcaagtgcactgcggccaaagagaccagaaacgcccaagcaaactggccctgttattattgaaacctgggtagcagaagaagaactggaattgtgggagatcagggcatttgctgagagagtggagaaagaaaaggcacaagcagttgagcaacaggctaagaaacgactggagcagcagaagccgacagtgattgcaacttccactacttccccaacaagcagtacaaccagcaccatctctccagcacagaaggttatggtggcccccataagtggctcagttacaactggaaccaaaatggtactaactactaaagttggatctccagctacagtaacattccaacaaaacaagaactttcatcaaacctttgctacatgggttaagcaaggccagtcaaattcagccaccagcacagctgccacatctgctacaaccattgccagcacaggtcagacgttccaaattacaggcaatccagtcactatggcaggaaaagtaattaccaaactgccacttcctgcaaacagcaagattgtcgctgtaaatgtgccagcaacacaaggaggcgttgttcaagtacagcagaaagtcctgggtatcattccatcaagtacaggtaccagtcagcaaacctttacttcattccagcccaggacagcaacagtcacaattaggcccaatacctcaggctctggaggaaccacaagcaattcacaagtaatcacagggcctcagattcgccctggtatgaccgtgattagaacaccactccaacagtcaacactaggaaaggcaattattcgaacacctgtgatggtacagccaggtgctcctcagcaagtgatgactcaaatcatcagggggcagcctgtctccactgcagtctccgcccctaacacggtttcctcaacacctgggcagaaaagcttaact

SEQ ID NO: 112338 - DNA, 1582 bp, Homo sapiens
  Payload ID: 1987
  Gene Symbol: BPTF
  Gene Name: bromodomain PHD finger transcription factor
  ENST ID: ENST00000581258
  CDS Start-End: 1-1262
aacatttaaaacagaaaaagagcatgactccagctgaaagagaagagaatcaaagaatgattgtctgtaaccaggtgatgaagtatattttggataagatagataaagaagaaaaacaggcagcaaaaaaacggaagcgtgaagagagtgtggagcagaaacgtagcaagcagaatgccactaagctgtcagctctgctcttcaagcacaaagagcagctcagagccgagatcctgaagaagagagcactcctggacaaggatctgcaaattgaagtgcaggaagagctgaagagagacctgaaaattaagaaagaaaaagacctgatgcagttggctcaggccacagcagtagctgcaccctgccccccagtgacaccagctcctccagcccctccagcccctccaccttcacctccccctccacctgctgtgcaacacacaggccttctgtccacgcccaccttacctgctgcttcccagaagaggaagcgggaagaggaaaaagactccagctcaaagtccaagaaaaagaaaatgatctctactacctcaaaggaaactaagaaggacacaaagctttactgtatctgtaaaacgccttatgatgaatctaagttctatattggctgtgatctttgtactaactggtatcatggagaatgtgttggcatcacagaaaaggaggctaagaaaatggatgtgtacatctgtaatgattgtaaacgggcacaagagggcagcagtgaggaattgtactgtatctgcagaacaccttatgatgagtcacaattttatattggctgtgatcggtgtcagaattggtaccatgggcgctgcgttggcatcttgcaaagtgaggcagagctcattgatgagtatgtctgtccacagtgccagtcaacagaggatgccatgacagtgctcacgccactaacagagaaggattatgaggggttgaagagggtgctccgttccttacaggcccataagatggcctggcctttccttgaaccagtagaccctaatgatgcaccagattattatggtgttattaaggaacctatggaccttgccaccatggaagaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcagattgtgatatctttagtctgaatttttaactggaatcagaactggatgttggggtcactctttgttttattgtacctcgtgattacctaattcaaaattgccccccaaaaagtcagattagttaatataattttttaatgttaaagatgtatcgtggtaaaaaatttactctagcagccatgttgaacaatgtatttaaaaattgtaaactcttggaatactgtatttatctgctatttcaatataaagtcctttgacttagtcctggtaactgtacagtaatttggtttactaatgaaagttgtgaataaaactgtgaaactagaa

SEQ ID NO: 112339 - DNA, 3409 bp, Homo sapiens
  Payload ID: 1988
  Gene Symbol: BRDT
  Gene Name: bromodomain, testis-specific
  Uniprot ID: Q58F21
  ENST ID: ENST00000362005
  CDS Start-End: 419-3262
tataaaagcgcctgtcgcgcgaccgccattacaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccagttcctcttaggtcttggactggtgtggatcgctgctgcctgtactgtaattttggaaatgcaggagaaagacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcataccgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttaca

SEQ ID NO: 112340 - DNA, 3696 bp, Homo sapiens
  Payload ID: 1988
  Gene Symbol: BRDT
  Gene Name: bromodomain, testis-specific
  Uniprot ID: Q58F21
  ENST ID: ENST00000370389
  CDS Start-End: 925-3549
tataaaagcgcctgtcgcgcgaccgccattacaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccagttcctcttaggtcttggactggtgtggatcgctgctgcctgtactgtaattttggaaatgcaggagaaagtacggagcgtttagctttagctggcattttgtgtttattctgcaagtggtcatttgggacggggaagttcgggttcttgcttcatttatttattcaattaactttattaagcccctggaacgtctgaaccctcttttgggtactgcaggattgtggtgggctttacttcaaggcgcgctggcctgtattaagaattaagatagaggaggccgggtgcagtggctcgcccctgtaatctcagcactttcggaggccgaggcaagtggatcacctgaggtcaggagttcaagaccagcctggccaacataatgaaatgcccatctctaccaaaaatacaaaaattagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagaggattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcataccgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttaca

SEQ ID NO: 112341 - DNA, 3207 bp, Homo sapiens
  Payload ID: 1988
  Gene Symbol: BRDT
  Gene Name: bromodomain, testis-specific
  Uniprot ID: Q58F21
  ENST ID: ENST00000394530
  CDS Start-End: 350-3055
tataaaagcgcctgtcgcgcgaccgccattacaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcataccgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacattttt

SEQ ID NO: 112342 - DNA, 3125 bp, Homo sapiens
  Payload ID: 1988
  Gene Symbol: BRDT
  Gene Name: bromodomain, testis-specific
  Uniprot ID: Q58F21
  ENST ID: ENST00000402388
  CDS Start-End: 135-2978
aagagcattttaagaatcataatagttcagtgcagatgttcctgggaggtcaagttaagagtcaaaaataattcattagatttaacaatttagcatggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcataccgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttaca

SEQ ID NO: 112343 - DNA, 3357 bp, Homo sapiens
  Payload ID: 1988
  Gene Symbol: BRDT
  Gene Name: bromodomain, testis-specific
  Uniprot ID: Q58F21
  ENST ID: ENST00000399546
  CDS Start-End: 350-3205
tataaaagcgcctgtcgcgcgaccgccattacaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggtaaggcaggaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcataccgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacattttt

SEQ ID NO: 112344 - DNA, 760 bp, Homo sapiens
  Payload ID: 1988
  Gene Symbol: BRDT
  Gene Name: bromodomain, testis-specific
  ENST ID: ENST00000423434
  CDS Start-End: 231-760
ataaaagcgcctgtcgcgcgaccgccattacaacaaaaactggcggcgaggaactgcggagaactgttgccctgcaccgcttcattttgtgcagcctgaaaggggcaatcacataaggtcggttttgtaatatacaggtaacatacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaat

SEQ ID NO: 112345 - DNA, 1363 bp, Homo sapiens
  Payload ID: 1988
  Gene Symbol: BRDT
  Gene Name: bromodomain, testis-specific
  ENST ID: ENST00000427104
  CDS Start-End: 898-1363
attacaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccaggtcttggactggtgtggatcgctgctgcctgtactgtaattttggaaatgcaggagaaagtacggagcgtttagctttagctggcattttgtgtttattctgcaagtggtcatttgggacggggaagttcgggttcttgcttcatttatttattcaattaactttattaagcccctggaacgtctgaaccctcttttgggtactgcaggattgtggtgggctttacttcaaggcgcgctggcctgtattaagaattaagatagaggaggccgggtgcagtggctcgcccctgtaatctcagcactttcggaggccgaggcaagtggatcacctgaggtcaggagttcaagaccagcctggccaacataatgaaatgcccatctctaccaaaaatacaaaaattagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctg

SEQ ID NO: 112346 - DNA, 534 bp, Homo sapiens
  Payload ID: 1988
  Gene Symbol: BRDT
  Gene Name: bromodomain, testis-specific
  ENST ID: ENST00000355011
  CDS Start-End: 493-534
acaacaaaaactggcggcgaggaactgcggagaactgttgccctgcaccgcttcattttgtgcagcctgaaaggggcaatcacataaggattgtggtgggctttacttcaaggcgcgctggcctgtattaagaattaagatagaggaggccgggtgcagtggctcgcccctgtaatctcagcactttcggaggccgaggcaagtggatcacctgaggtcaggagttcaagaccagcctggccaacataatgaaatgcccatctctaccaaaaatacaaaaattagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagaggacatgtacttgtagacaggattcaaagcagttaagaatgtctctgccaagtcgacaaacagctattattgttaaccct

SEQ ID NO: 112347 - DNA, 1707 bp, Homo sapiens
  Payload ID: 1988
  Gene Symbol: BRDT
  Gene Name: bromodomain, testis-specific
  ENST ID: ENST00000426141
  CDS Start-End: 320-1707
acaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaa

SEQ ID NO: 112348 - DNA, 551 bp, Homo sapiens
  Payload ID: 1988
  Gene Symbol: BRDT
  Gene Name: bromodomain, testis-specific
  ENST ID: ENST00000457265
  CDS Start-End: 457-551
actgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagaggacatgtacttgtagacaggattcaaagcagttaagaatgtctctgccaagtcgacaaacagctattattgttaaccctcctccaccagaatatataaatactaagaaaaatgggcgattgacaaatcaact

SEQ ID NO: 112349 - DNA, 550 bp, Homo sapiens
  Payload ID: 1988
  Gene Symbol: BRDT
  Gene Name: bromodomain, testis-specific
  ENST ID: ENST00000449584
  CDS Start-End: 395-550
attacaacaaaaactggcggcgaggaactgcggagaactgttgccctgcaccgcttcattttgtgcagcctgaaaggggcaatcacataagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagagatagctgctatggctgggcgatctcagaggatcgcctgagtcgctcacgcctgtaatcccagcacttaggaggccgaggcgggtggatcacctgaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggcccttt

SEQ ID NO: 112350 - DNA, 591 bp, Homo sapiens
  Payload ID: 1988
  Gene Symbol: BRDT
  Gene Name: bromodomain, testis-specific
  ENST ID: ENST00000448194
  CDS Start-End: 126-591
acaacaaaaactggcggcgaggaactgcggagaactgttgccctgcaccgcttcattttgtgcagcctgaaaggggcaatcacataaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctg

SEQ ID NO: 112351 - DNA, 559 bp, Homo sapiens
  Payload ID: 1988
  Gene Symbol: BRDT
  Gene Name: bromodomain, testis-specific
  ENST ID: ENST00000450792
  CDS Start-End: 272-559
aacaaaaactggcggcgaggaactgcggagaactgttgccctgcaccgcttcattttgtgcagcctgaaaggggcaatcacataaggtcggttttgtaatatacaggtaacatacagtccgggcagttgagaaggccaccccgcttcgtgcctgcagcccaggttcacagcaaaactgagcagtaaatagtgttcccatctaccccgtttcaacactagtacagcaccagagtggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaa

SEQ ID NO: 112352 - DNA, 788 bp, Homo sapiens
  Payload ID: 1988
  Gene Symbol: BRDT
  Gene Name: bromodomain, testis-specific
  ENST ID: ENST00000440509
  CDS Start-End: 188-788
gtcgcgcgaccgccattacaacaaaaactggcggcgaggaactgcggagaactgttgccctgcaccgcttcattttgtgcagcctgaaaggggcaatcacataagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagtt

SEQ ID NO: 112353 - DNA, 578 bp, Homo sapiens
  Payload ID: 1988
  Gene Symbol: BRDT
  Gene Name: bromodomain, testis-specific
  ENST ID: ENST00000552654
  CDS Start-End: 389-578
aacaaaaactggcggcgaggaactgcggagaactgttgccctgcaccgcttcattttgtgcagcctgaaaggggcaatcacataaggtcggttttgtaatatacaggtaacatacagtccgggcagttgagaaggccaccccgcttcgtgcctgcagcccaggtcttggactggtgtggatcgctgctgcctgtactgtaattttggaaatgcaggagaaaaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaag

SEQ ID NO: 112354 - DNA, 569 bp, Homo sapiens
  Payload ID: 1988
  Gene Symbol: BRDT
  Gene Name: bromodomain, testis-specific
  ENST ID: ENST00000548992
  CDS Start-End: 269-569
aacaaaaactggcggcgaggaactgcggagaactgttgccctgcaccgcttcattttgtgcagcctgaaaggggcaatcacataaggtcggttttgtaatatacaggtaacatacagtccgggcagttgagaaggccaccccgcttcgtgcctgcagcccagttcctcttaggtcttggactggtgtggatcgctgctgcctgtactgtaattttggaaatgcaggagaaagacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaa

SEQ ID NO: 112355 - DNA, 2579 bp, Homo sapiens
  Payload ID: 1989
  Gene Symbol: BTK
  Gene Name: Bruton agammaglobulinemia tyrosine kinase
  Uniprot ID: Q06187
  ENST ID: ENST00000308731
  CDS Start-End: 165-2144
gctcagactgtccttcctctctggactgtaagaatatgtctccagggccagtgtctgctgcgatcgagtcccaccttccaagtcctggcatctcaatgcatctgggaagctacctgcattaagtcaggactgagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaa

SEQ ID NO: 112356 - DNA, 2248 bp, Homo sapiens
  Payload ID: 1989
  Gene Symbol: BTK
  Gene Name: Bruton agammaglobulinemia tyrosine kinase
  ENST ID: ENST00000372880
  CDS Start-End: 359-1810
aactgagtggctgtgaaagggtggggtttgctcagactgtccttcctctctggactgtaagaatatgtctccagggccagtgtctgctgcgatcgagtcccaccttccaagtcctggcatctcaatgcatctgggaagctacctgcattaagtcaggactgagagctgtgtgttacacaccaaccttctggaggactcaaaaatggatccctttcctttcacattattgagtgatggaccagtggcacctaaggaagagctaccacattttcaggctgtgtgagtctggactggatcataagaaacaggagaaaagcagtcaaagaagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtc

SEQ ID NO: 112357 - DNA, 2417 bp, Homo sapiens
  Payload ID: 1989
  Gene Symbol: BTK
  Gene Name: Bruton agammaglobulinemia tyrosine kinase
  ENST ID: ENST00000618050
  CDS Start-End: 1-1707
atggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaatcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtc

SEQ ID NO: 112358 - DNA, 2767 bp, Homo sapiens
  Payload ID: 1989
  Gene Symbol: BTK
  Gene Name: Bruton agammaglobulinemia tyrosine kinase
  Uniprot ID: Q06187
  ENST ID: ENST00000621635
  CDS Start-End: 248-2329
ttcgtcactttatctcttttggtggactctgctacgtagtggcgttcagtgaagggagcagtgtttttcccagatcctctggcctccccgtccccgagggaagccaggactagggtcgaatgaaggggtcctccacctccacgttccattcctgttccacctcaaggtcactgggaacacctttcgcagcaaactgctaattcaatgaagacctggagggagccaattgttccagttcatctatcacatggccagttggtccattcaacaaatggttattggatgcccattatgtggcaggcactgttccgggggagagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtc

SEQ ID NO: 112359 - DNA, 1926 bp, Homo sapiens
  Payload ID: 1990
  Gene Symbol: BRIX1
  Gene Name: BRX1, biogenesis of ribosomes
  Uniprot ID: Q8TDN6
  ENST ID: ENST00000336767
  CDS Start-End: 364-1425
cgcttactagtctcggggtccccgagtgcggaaaccctacctttgcggtggggtctggacgcccgagagcccttctcagcaaagtccctgaagaggagcgaggcggctccgaggaaccgcggaggaagtgaagccagtcccgccactcttcagaccggccctccacctcggccaccgtcaccacagagctgaaggaggcctagagagccgcgcgtgccgcgccaccgagaccggaaggaggcggcacagacctggaggacgaccgcggagctgagcgcttagagccgccgaaccatagagatcggaaataggagcgagcggcagcgccggaaaggaggccaagagcgcgggcggcgaggcaagatggcggcaaccaagaggaaacggcgtggaggctttgcagttcaggcgaagaagccaaaaagaaacgaaatagatgcggagccgccagctaagcggcacgccacagcagaggaggtggaggaagaagagagggaccggatcccaggccccgtttgcaagggaaagtggaaaaataaggaacggattctcatcttttcttccagaggaataaattttagaacaagacatttaatgcaggacttgagaatgttgatgcctcattctaaagcagatactaaaatggatcgtaaggataagctatttgtgattaacgaggtttgtgaaatgaagaactgtaataaatgcatctattttgaagctaagaaaaaacaggatctctatatgtggctttcaaattcacctcacggaccatctgctaaattccttgttcaaaatattcataccctcgctgaactgaagatgactggaaactgtttgaaaggttctcggccccttttgtcttttgaccctgcttttgatgaattaccacattatgctttgttaaaagaactcttaattcagatctttagtacaccacggtatcatcccaaaagccaaccatttgtggaccacgtgtttactttcaccattttggataataggatatggtttcggaactttcagatcatagaagaagatgctgctcttgtagaaataggacctcgttttgtcttaaatctcataaagattttccagggaagttttggaggaccaactttatatgaaaatcctcactaccagtcaccaaacatgcatcggcgtgtcataagatccatcacagctgcaaaatacagagagaaacagcaagtgaaagatgtgcaaaaactgagaaagaaagagccgaagactcttcttccacatgatcccactgcagatgtttttgtaacaccagctgaggagaaaccaatagaaatacagtgggtaaaaccagagccaaaagttgatttgaaagcaagaaagaaacggatttacaaaaggcaaagaaaaatgaaacagaggatggacagtgggaaaacaaaataagtcaatggaaacctgatttgtttttcagttactttatatttattttgtattcaatgtgtaaatacttttattatctaatactatcttacgtctaattagtgtagcatttacaagaaagaaaaattaagatcttaaaatcagtgattatctttttctaaataaaatatcaccagaattcatcagttaatttctgatttctttttgaagtttgtgttgctaaaaatgtagcacacttaatgtagcctgttctcttgggttggaatttttggtttagcaaagctgaaattcagacatttattaggtcatattatttgtaaaagcattcaacacttcaagagcatcggttgtggatggtaaagtaggagtagactggtagaaaggaaggcatctcactgaagtttactcagtcatcagttaatgaagccatggaagaaccaacccctgatctgtcacttcaaaaaagagtatattaaaatgttgaggttttgagaatcaaatgca

SEQ ID NO: 112360 - DNA, 4599 bp, Homo sapiens
  Payload ID: 1991
  Gene Symbol: BSDC1
  Gene Name: BSD domain containing 1
  Uniprot ID: Q9NW68
  ENST ID: ENST00000341071
  CDS Start-End: 13-1437
catgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctattgcagcctgttcccggggcgcttgcttcctctgcccgttctctatacagacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaaggaaaaaagaaaacagacatcaaaccctgcctgaccttctgagttgtggtcctcaggtatgaggcctgagtatatacttggccttggagacaaaagaccagtgtgatcaagggcaagggcaagttacttaacctgagcccctggttcctcatctaaaacatggaattgatcattataagacctggctataagctgtaatgaggtgatccatgtagacaccttagggctattgcctgagacatggtgaccagcactcaggagacattagtgataaaccccacaaaacccattccagttattaagctcaaggaggccttagtactgttattcttcactacctctcagaatcaaaagtggctcatttagattgagaggctggaacagtccaaagctctcccagctaataagtgacaggactgaggctgcaacccagacatctgattcatgtcagcgttagttccactgtcacataagaaccacatgagtccttccatcatgtaacttatgagcctgttagaaagaggtggacagattagagagacatgtgaagggcctcctttttcatgatgggaaactgaagccttgggggagtattttacctactcaggagtattttgcacttgtgactacctcactatacccaggacagagaaagcccatagtgccctgtcaggccacaggggcttgctggctttttgtgtctttgcagccccctttaaaacctgacgtgcagtacacgtgagcattctagaacctgctataccagggcttagccgacagcaggccaagagtaggaacaaagcaagaaaacgttccgtggggagacttgagctgggaattagggtgttggtgcccctagtgaagacctagtgggcatctgtaggccactgccacctctgcttttggccacagtgccactcaggcagtggcctccattcacccaaagactaagtaacttgcccttgattacactggtcttttgtgtccagggccaagtatctgctcaggcctcctgagttctctgcttctcagagccatggcattatctgctcagcaggaggcaagttctccttaaaggactgaggctgacttggttcctgtaggcagccatcaccttgtggtgtctggtgttggttgggggaagtgtttcctttaggtctgaggtaatcagagcatcaggcccacccctcaggcagagggcagctctgcccctcagacacattccttaagactaggggttcactctcagtgggacctcagagtatggcctggggtaggggatgggaggtggctctgctcagcaagtggaggttaggtctgggcctgactcaggagtaactatgtgtttgtgatttccattaccccctcccatttgcagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcggatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaa

SEQ ID NO: 112361 - DNA, 1630 bp, Homo sapiens
  Payload ID: 1991
  Gene Symbol: BSDC1
  Gene Name: BSD domain containing 1
  ENST ID: ENST00000373520
  CDS Start-End: 15-209
gtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctgggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaa

SEQ ID NO: 112362 - DNA, 1505 bp, Homo sapiens
  Payload ID: 1991
  Gene Symbol: BSDC1
  Gene Name: BSD domain containing 1
  Uniprot ID: Q9NW68
  ENST ID: ENST00000446293
  CDS Start-End: 17-1360
atgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctattgcagcctgttcccggggcgcttgcttcctctgcccgttctctatacagacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgct

SEQ ID NO: 112363 - DNA, 1473 bp, Homo sapiens
  Payload ID: 1991
  Gene Symbol: BSDC1
  Gene Name: BSD domain containing 1
  Uniprot ID: Q9NW68
  ENST ID: ENST00000419121
  CDS Start-End: 28-1152
aaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctgctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagt

SEQ ID NO: 112364 - DNA, 2846 bp, Homo sapiens
  Payload ID: 1991
  Gene Symbol: BSDC1
  Gene Name: BSD domain containing 1
  Uniprot ID: Q9NW68
  ENST ID: ENST00000455895
  CDS Start-End: 35-1327
ggtcagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcggatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 112365 - DNA, 2925 bp, Homo sapiens
  Payload ID: 1991
  Gene Symbol: BSDC1
  Gene Name: BSD domain containing 1
  Uniprot ID: Q9NW68
  ENST ID: ENST00000444377
  CDS Start-End: 15-1301
gtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaagagacaaggtctcagttcactgttgatttcctctggaagatttctgtgactctcttggagcctctgggccaaagtgcttctccgctctttagtaacctgccttttccgaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcggatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcaccc

SEQ ID NO: 112366 - DNA, 1361 bp, Homo sapiens
  Payload ID: 1991
  Gene Symbol: BSDC1
  Gene Name: BSD domain containing 1
  Uniprot ID: Q9NW68
  ENST ID: ENST00000526031
  CDS Start-End: 28-1035
aaatagtggtgatgtcatgcaggcaagatggcggaaggggaggacgtgggatggtggcggagctggctgcagcagagctaccaagcagtcaaagagaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaa

SEQ ID NO: 112367 - DNA, 567 bp, Homo sapiens
  Payload ID: 1991
  Gene Symbol: BSDC1
  Gene Name: BSD domain containing 1
  ENST ID: ENST00000527163
  CDS Start-End: 35-567
atgcaggcaagatggcggaaggggaggacgtgggatggtggcggagctggctgcagcagagctaccaagcagtcaaagagaaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggc

SEQ ID NO: 112368 - DNA, 576 bp, Homo sapiens
  Payload ID: 1991
  Gene Symbol: BSDC1
  Gene Name: BSD domain containing 1
  ENST ID: ENST00000527513
  CDS Start-End: 12-281
atgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaa

SEQ ID NO: 112369 - DNA, 482 bp, Homo sapiens
  Payload ID: 1991
  Gene Symbol: BSDC1
  Gene Name: BSD domain containing 1
  ENST ID: ENST00000530485
  CDS Start-End: 15-482
gtcatgcaggcaagatggcggaaggggaggacgtgggatggtggcggagctggctgcagcagagctaccaagcagtcaaagagaagacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccat

SEQ ID NO: 112370 - DNA, 7250 bp, Homo sapiens
  Payload ID: 1992
  Gene Symbol: BTAF1
  Gene Name: BTAF1 RNA polymerase II, B-TFIID transcription factor-associated, 170kDa
  Uniprot ID: O14981
  ENST ID: ENST00000265990
  CDS Start-End: 309-5858
cagttgtgcgtgccgacgcccgcgtcagcaaagagcggagctgagggtacccggtttgaagtcgtgcgggtcggaggactgccgcctccgctaccgtcttggacccctgcttaccggccgccgcggggacgagctcgggtaggcggcagggcagatgcccgagggcctgcgctggaacgccccacgccgcaccggccgctcccctgtgctccgcggcctgggcctgcgccgctcagctctctggaaactagcgcctcagctgcgcggcgcgtaggtcgcggggagctccgaaccgccggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgtaaaa

SEQ ID NO: 112371 - DNA, 6938 bp, Homo sapiens
  Payload ID: 1992
  Gene Symbol: BTAF1
  Gene Name: BTAF1 RNA polymerase II, B-TFIID transcription factor-associated, 170kDa
  ENST ID: ENST00000544642
  CDS Start-End: 1-5550
atgggagtattcaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgt

SEQ ID NO: 112372 - DNA, 3297 bp, Homo sapiens
  Payload ID: 1993
  Gene Symbol: BTBD1
  Gene Name: BTB (POZ) domain containing 1
  Uniprot ID: Q9H0C5
  ENST ID: ENST00000261721
  CDS Start-End: 204-1652
agtcctgttacacctcccgcggccgcgcacagcggcaacccgggcgtgcgggggcgcgcgcggtcagggaggggcctgcggaggcgcgaggcccccggaagcgcctttcccggaaggcagggaggcagcgccggcctccggaggcggcctgggcgatggcggcggagttttgtccataacgtgggcaaccgcgcagctggaggatggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgtaagataagaaacagtttcttagagcagatagaaaaatgcttatttaaatctttgcatgatttaaaaacagattttccattttcttacaactttaagagaaaagaactgggtttaatggtttaaaaaaaagcacagctttttcaccttcatcttgtataatttcatagattggctgacttagggtctttcaatagtttgggaattgaaagattcttgttatatatagctagtttgggtttgtttttgttttaactattttgaaggttaggtgagatgggcaaataggcttaactattttgaaggttggatgaaaagagatgggtcagtattcctacagaattcttattaactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccactatacctgtctctctgtgtgggggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgatatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttttaaaaataaataaatatatatatatataaaaaaaac

SEQ ID NO: 112373 - DNA, 1467 bp, Homo sapiens
  Payload ID: 1993
  Gene Symbol: BTBD1
  Gene Name: BTB (POZ) domain containing 1
  Uniprot ID: Q9H0C5
  ENST ID: ENST00000379403
  CDS Start-End: 1-1158
atggcctcactcgggcctgccgcagctggggagcaggcgtcgggggctgaggcggagccgggccccgcggggccgccgccgccgccctcaccgtcctctctggggcccctgctccccctgcagcgggaacctctctacaactggcaggcgaccaaggcgtcgctgaaggagcgcttcgccttcctcttcaactcggagctgctgagcgatgtgcgcttcgtactgggcaagggtcgcggcgccgccgccgctgggggcccgcagcgcatccccgcccaccgcttcgtgctggcggccggcagcgccgtctttgacgccatgttcaacggcggcatggccaccacgtcggccgagatcgagctgccggacgtggagcccgcagccttcctggcgctgctgagatttctatattcagatgaagttcaaattggtccagaaacagttatgaccactctttatactgccaagaaatacgcagtcccagccttggaagcacactgtgtagaatttctcaccaaacatcttagggcagataatgcctttatgttacttactcaggctcgattatttgatgaacctcagcttgctagtctttgtctagatacaatagacaaaagcacaatggatgcaataagtgcagaagggtttactgatattgatatagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcagatcattgaatatgagaaaaagcaaaccctgggacagaatgataccggctttagttgtgatgggacagctaacacattcagggtcatgttcaaggaacccatagagatcctgcccaatgtgtgctacacagcatgtgcaacactcaaaggtccagattcccactatggcacaaaaggattgaagaaagtagtgcatgagacacctgctgcaagcaagactgtttttttcttttttagttcccctggcaataataatggcacttcaatagaagatggacaaattccagaaatcatattttatacataatttagcattataatacatcttggctaaataataccatacaatctagtgtcaaaaacataaatggccacaaaaaagtagtttgagtgttatgaatatttaaaattgt

SEQ ID NO: 112374 - DNA, 797 bp, Homo sapiens
  Payload ID: 1993
  Gene Symbol: BTBD1
  Gene Name: BTB (POZ) domain containing 1
  ENST ID: ENST00000559652
  CDS Start-End: 1-112
gaaatacgcagtcccagccttggaagcacactgtgtagaatttctcaccaaacatcttagggcagataatgcctttatgttacttactcagatacactctgtgcagttttagagagagacacactcagtattcgagaaagtcgactttttggagctgttgtacgctgggcagaagcagaatgtcagagacaacaattacctgtgacttttgggaataaacaaaaagttctaggaaaagcactttccttaatccggttcccactgatgacaattgaggaatttgcagcaggtcctgctcaatctggaattttgtcagatcgtgaagtggtaaacctctttcttcattttactgtcaaccctaaaccccgagttgaatacattgaccgaccaagatgctgtctcaggggaaaggaatgctgcatcaatagattccagcaagtagaaagccgctggggttacagtgggacgagtgatcgaatcaggcaaatataaattatcaaaattgactgaagaagaaaagcctgaatagaccaattaccatggaaggaattaaaagttatcaaagaactgtcccttcacaaggtggtttttacagattcacagttaatagaaggatctctatagttggatttggcttgtatggatctattcatggccctacagattatcaagtgaatatacagatcattgaatatgagaaaaagcaaaccctgggacagaatgataccggctttagttgtgatgggacagctaacacattcagggtcatgttcaaggaacccatagagatcctgccc

SEQ ID NO: 112375 - DNA, 2504 bp, Homo sapiens
  Payload ID: 1994
  Gene Symbol: BTBD10
  Gene Name: BTB (POZ) domain containing 10
  Uniprot ID: Q9BSF8
  ENST ID: ENST00000278174
  CDS Start-End: 247-1674
tctcgcggtaagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagagttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcagtttggactgatattcatcacacctcagataaaatgcagagtaatatatagttgcactttataaatggtggttaaatggaaatgttcaagccattttatagttgtgatgcacaatataatttaagtgcttctgtcaaagtattcctccagtacaatttgtatagtttgctgcccttgatgagcaaaaagtatttatcttgggcttatctgaatgatcaggatgagatttaatgcccatatcttaccagttcagttatctccagagccatttcaccctttagagtgagtcacatgcagggagtgtgaatgtcagaggtggtttattatccagtctgccttacccttaatctgttcacagatatttatttactaatgctttttttttcttaagagttatgggataggaaaatgaagtgtttgctcttcatttactaaatgattgtaaacttgagtttttcatcaaaataaaattccattgttttaatgtttctgaccaaatttataa

SEQ ID NO: 112376 - DNA, 1871 bp, Homo sapiens
  Payload ID: 1994
  Gene Symbol: BTBD10
  Gene Name: BTB (POZ) domain containing 10
  Uniprot ID: Q9BSF8
  ENST ID: ENST00000530907
  CDS Start-End: 272-1723
acacgatgctgttttgttagaaacgtcagtgctgcacaacccacggctgagtcagtgtctgtgagaaaataaactgaattaatatgtagagggggttgtatctctgaatatttaaagcctaaatattgcaacagcattattacacagtagagggaggaagctaaaggaagtctatggacaggtgaggtagggggagactggggaattttctgattgttcagaggaatcttgaagatgatggaaatatcagatgtgctaaagtttcctagtaatgcccaaggatgctgacctggctttcagtgcttcattgtttgaaagagcagagtccctttatactctgatttcaaaatttttttcttgtttttgtgtgtctaccttggcatatactaaaggaagtacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaa

SEQ ID NO: 112377 - DNA, 508 bp, Homo sapiens
  Payload ID: 1994
  Gene Symbol: BTBD10
  Gene Name: BTB (POZ) domain containing 10
  ENST ID: ENST00000526841
  CDS Start-End: 316-508
gatctggctgaggaggaagtggaggtgtcactggccccggcctttgccccaatcttgtgtgggcactgaagggggactacagggcagaggaaccccgtgccccgcccctttcctgtcatctcagacgaacgcagcgacatcctgaggaaggcgcatcacaataggggataaggtggtgggcagcctccctctgggtgaagaggagtgagaccccactaacgtgctgcgtggttttatgttgtaaccattttacgtgtggttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagac

SEQ ID NO: 112378 - DNA, 616 bp, Homo sapiens
  Payload ID: 1994
  Gene Symbol: BTBD10
  Gene Name: BTB (POZ) domain containing 10
  ENST ID: ENST00000529708
  CDS Start-End: 419-616
gcggtaagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagaggcagaggaaccccgtgccccgcccctttcctgtcatctcagacgaacgcagcgacatcctgaggaaggcgcatcacaataggggataaggtggtgggcagcctccctctgggtgaagaggagtgagaccccactaacgtgctgcgtggttttatgttgtaaccattttacgtgtggttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagacgaagg

SEQ ID NO: 112379 - DNA, 1139 bp, Homo sapiens
  Payload ID: 1994
  Gene Symbol: BTBD10
  Gene Name: BTB (POZ) domain containing 10
  ENST ID: ENST00000525108
  CDS Start-End: 264-374
ctcttcgcattgtgagctctcgcggtaagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagagttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctag

SEQ ID NO: 112380 - DNA, 1662 bp, Homo sapiens
  Payload ID: 1994
  Gene Symbol: BTBD10
  Gene Name: BTB (POZ) domain containing 10
  ENST ID: ENST00000528120
  CDS Start-End: 250-1533
ctcttcgcattgtgagctctcgcggtaagaggctgaggagccggcctgcaacctgccggggcggctccgctacgcgcagccgcctcagtggcttcctccacagccacctccggagggatctggctgaggaggaagtggaggtgtcactggccccggcctttgccccaatcttgtgtgggcactgaagggggactacaggttcgagatacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgta

SEQ ID NO: 112381 - DNA, 2338 bp, Homo sapiens
  Payload ID: 1994
  Gene Symbol: BTBD10
  Gene Name: BTB (POZ) domain containing 10
  ENST ID: ENST00000527102
  CDS Start-End: 193-801
acgcgcagccgcctcagtggcttcctccacagccacctccggagggatctggctgaggaggaagtggaggtgtcactggccccggcctttgccccaatcttgtgtgggcactgaagggggactacaggttcgagagttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtctcagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccatcccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcagtttggactgatattcatcacacctcagataaaatgcagagtaatatatagttgcactttataaatggtggttaaatggaaatgttcaagccattttatagttgtgatgcacaatataatttaagtgcttctgtcaaagtattcctccagtacaatttgtatagtttgctgcccttgatgagcaaaaagtatttatcttgggcttatctgaatgatcaggatgagatttaatgcccatatcttaccagttcagttatctccagagccatttcaccctttagagtgagtcacatgcagggagtgtgaatgtcagaggtggtttattatccagtctgccttacccttaatctgttcacagatatttatttactaatgctttttttttcttaagagttatgggataggaaaatgaagtgtttgctcttcatttactaaatgattgtaaacttgagtttttcatcaaaataaaattccattgtttt

SEQ ID NO: 112382 - DNA, 5767 bp, Homo sapiens
  Payload ID: 1995
  Gene Symbol: BTBD11
  Gene Name: BTB (POZ) domain containing 11
  Uniprot ID: A6QL63
  ENST ID: ENST00000280758
  CDS Start-End: 529-3843
ggttcggcaaggtttgcagccgccacggccgctgctgcgctccggtgcagggcaggctggcgccgagcgaaccagggccgggaactgggagccgggagccgggagccagctgcccgcggagctgcggcggcggcggcatctggggtggtctcagtcccacgaacaccgtggccggcgcccggtggctactgcgcccagcggggctcagggaagagcggtctagacactttttattttggaagaaaggggcaagccccggcgggagcttccttcccggcctggctcgctccccattgcgcccagctccggcccggactctggaagatgactccagggtctgctctgtatattccagcggcggcagttccgggaggcagccgaaagtactaacagttggtagcagcggctagtggaaaagtgagccaaggcggcgcggactcggctctccccgcgccccgcggcactcgctgctcctcgccgctccttccctttggctcccaggcggctgcagcatgaagtggcgcagcgatggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggaaattttgagctggttagtttgctgttggagcgtggtgccgatcccctgataggaaccatgtacaggaatggaatttctacaaccccccagggtgatatgaactctttcagccaggctgcagcccacggacacaggaatgtgttccgcaaactgctcgcccagccagagaaggagaagagtgatatcctgtccctggaggagattctggccgaggggactgacctggcggagacagccccgccccccttgtgcgccagccgcaacagcaaggccaaactgagggccctgagggaggccatgtatcacagcgctgagcatggctacgtggatgtcacaattgatatcaggagcataggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatgaaacgcctagtgcagggaatgcttcccgggaactttccagttctcctgccgcattggctttacacaaacacagacaaattccacctggcacctgtttttggctgggccaaggagctgcctctactgctcccacgtgttcctgttgaaaaacaaaggactttccactggtctgcagatcagatcagctgggtccagagtttaatgggcaactggacaaccaagttaaccccaattgaaagcacccctaggaccattgaacacccactgccggggaccactgtccagtgaatggattgaggccttttaaaggtcactcaggttccaggttgacagttggaggacttcaccgtaccaaccctgaagagattgtattacacattaaggaccttggtagctgtgcttcagcaaacgtcaaccatggtagcaaattggtgaggctgtgaccaataatgaggaaataatctggcaaatttttaggggtgggaacttttttaaatgttcatttaaaaaaaaacaaaaacagggcagtcttgtagtttaaaatatatttctaaaagcttaacagttcgttttcaactaaattgtgtttagggatctgtgtttgagatttttctttatttcttttttttttttaaatagtaagtcacaggtccacactgtgtaaacatgcatctgataagatactgctgatattctaaacaagttgaaataatcttgccttagtgatcatgattacacaaaagaggtgcactgccaataagtatctctaattcaatagttgaaagcaacctgcatgctaatcgtggtttcggggtgagaataaaacacccccacataacatgcatttgcatgggcccgaacctgtgaaatgttacgtttgtgcttcatttttgccaaggtaaaaatgttccatcatttctagctaaaactccatttggtgaaaccaacatatccatttcttttcctagttacggatgatttggggatgcttttgcagaaatgtgttcatagatgatgctgaatgggggaggggggcagcacgtcagagaatttactattaatcccagagttttctctgtattctcagaagatgttaatagtttgttactagccagagagtatgactatgttagattatttttaaagatgaaacatgtatgataggatggattctttctgtattctgagagtgtacagtacaggattattataatgaaagtttatatcaacagggtttcgttggctctgccatatattataagcaaaagagattggtaaagtgccacagtattccagataacttttcagttgcggcctttcttctcgttctttaatttgaaacctagatacatgcagtaaaaactaggagaatgacttttacccttggggacagccaagttttgttgataaacctatttcctagcatgccttcaggaagttgtgccagaccctagattgtgaaggacccactgttcttctgttgtacgagctccctgaaccattgttcagaggaccaatgtcacatcgcttcatgggcatggcccatggagcatctgggtgatatctgtctacagtattggctcttctgcgaggctgatacacaaggcctctcttccacatgatcatttgcaaacctcccccagcccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttggtgtgctttctctgtcattaaaagaaatgattttcccaggc

SEQ ID NO: 112383 - DNA, 4107 bp, Homo sapiens
  Payload ID: 1995
  Gene Symbol: BTBD11
  Gene Name: BTB (POZ) domain containing 11
  Uniprot ID: A6QL63
  ENST ID: ENST00000357167
  CDS Start-End: 258-2183
aaagagctccagaaagacgacagggacgaggctgcagatgggaagggagtgctagcggacaccttaggcttgggtccacaatcagggagccccaaatagaaataacacggggcgctgattggttttccgccgctccagaccctgcgcttggtgcttcaagtgactcatccttatgttcacatgatcgccgagagggataatattcccagatcagttacctcctagcctttcctagtcacattatccccaggctacagatgaggaaactgaggcccaaggattccagagagcctgccccggggtcaccggtgcggtccggatgtctccaaaggctctcccactactctggaattcagaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggaaattttgagctggttagtttgctgttggagcgtggtgccgatcccctgataggaaccatgtacaggaatggaatttctacaaccccccagggtgatatgaactctttcagccaggctgcagcccacggacacaggaatgtgttccgcaaactgctcgcccagccagagaaggagaagagtgatatcctgtccctggaggagattctggccgaggggactgacctggcggagacagccccgccccccttgtgcgccagccgcaacagcaaggccaaactgagggccctgagggaggccatgtatcacagcgctgagcatggctacgtggatgtcacaattgatatcaggagcataggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatgaaacgcctagtgcagggaatgcttcccgggaactttccagttctcctgccgcattggctttacacaaacacagacaaattccacctggcacctgtttttggctgggccaaggagctgcctctactgctcccacgtgttcctgttgaaaaacaaaggactttccactggtctgcagatcagatcagctgggtccagagtttaatgggcaactggacaaccaagttaaccccaattgaaagcacccctaggaccattgaacacccactgccggggaccactgtccagtgaatggattgaggccttttaaaggtcactcaggttccaggttgacagttggaggacttcaccgtaccaaccctgaagagattgtattacacattaaggaccttggtagctgtgcttcagcaaacgtcaaccatggtagcaaattggtgaggctgtgaccaataatgaggaaataatctggcaaatttttaggggtgggaacttttttaaatgttcatttaaaaaaaaacaaaaacagggcagtcttgtagtttaaaatatatttctaaaagcttaacagttcgttttcaactaaattgtgtttagggatctgtgtttgagatttttctttatttcttttttttttttaaatagtaagtcacaggtccacactgtgtaaacatgcatctgataagatactgctgatattctaaacaagttgaaataatcttgccttagtgatcatgattacacaaaagaggtgcactgccaataagtatctctaattcaatagttgaaagcaacctgcatgctaatcgtggtttcggggtgagaataaaacacccccacataacatgcatttgcatgggcccgaacctgtgaaatgttacgtttgtgcttcatttttgccaaggtaaaaatgttccatcatttctagctaaaactccatttggtgaaaccaacatatccatttcttttcctagttacggatgatttggggatgcttttgcagaaatgtgttcatagatgatgctgaatgggggaggggggcagcacgtcagagaatttactattaatcccagagttttctctgtattctcagaagatgttaatagtttgttactagccagagagtatgactatgttagattatttttaaagatgaaacatgtatgataggatggattctttctgtattctgagagtgtacagtacaggattattataatgaaagtttatatcaacagggtttcgttggctctgccatatattataagcaaaagagattggtaaagtgccacagtattccagataacttttcagttgcggcctttcttctcgttctttaatttgaaacctagatacatgcagtaaaaactaggagaatgacttttacccttggggacagccaagttttgttgataaacctatttcctagcatgccttcaggaagttgtgccagaccctagattgtgaaggacccactgttcttctgttgtacgagctccctgaaccattgttcagaggaccaatgtcacatcgcttcatgggcatggcccatggagcatctgggtgatatctgtctacagtattggctcttctgcgaggctgatacacaaggcctctcttccacatgatcatttgcaaacctcccccagcccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttggtgtgctttctctgtcattaaaagaaatgattttcccaggc

SEQ ID NO: 112384 - DNA, 723 bp, Homo sapiens
  Payload ID: 1995
  Gene Symbol: BTBD11
  Gene Name: BTB (POZ) domain containing 11
  ENST ID: ENST00000415943
  CDS Start-End: 12-723
gtaccggctgaatggttgaaagcttgcacggcctagacagtcgtaaaggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagg

SEQ ID NO: 112385 - DNA, 3478 bp, Homo sapiens
  Payload ID: 1995
  Gene Symbol: BTBD11
  Gene Name: BTB (POZ) domain containing 11
  Uniprot ID: A6QL63
  ENST ID: ENST00000420571
  CDS Start-End: 521-3478
aaggtttgcagccgccacggccgctgctgcgctccggtgcagggcaggctggcgccgagcgaaccagggccgggaactgggagccgggagccgggagccagctgcccgcggagctgcggcggcggcggcatctggggtggtctcagtcccacgaacaccgtggccggcgcccggtggctactgcgcccagcggggctcagggaagagcggtctagacactttttattttggaagaaaggggcaagccccggcgggagcttccttcccggcctggctcgctccccattgcgcccagctccggcccggactctggaagatgactccagggtctgctctgtatattccagcggcggcagttccgggaggcagccgaaagtactaacagttggtagcagcggctagtggaaaagtgagccaaggcggcgcggactcggctctccccgcgccccgcggcactcgctgctcctcgccgctccttccctttggctcccaggcggctgcagcatgaagtggcgcagcgatggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatga

SEQ ID NO: 112386 - DNA, 4614 bp, Homo sapiens
  Payload ID: 1995
  Gene Symbol: BTBD11
  Gene Name: BTB (POZ) domain containing 11
  Uniprot ID: A6QL63
  ENST ID: ENST00000490090
  CDS Start-End: 1-3024
atggccaggagaggtaagaagcccgtggtgagaacgctggaggatctgacgctggactcgggttatggtggcgcggcggactcggtgcgctcctccaacttgtctttgtgctgttccgactcgcacccggcgtccccgtatggcgggagctgctggccgcctctagctgactccatgcacagccggcacaacagctttgacactgtcaacactgccctggtggaagactccgaggggctggactgcgccggccagcactgctcgcggctgctgccggacctagacgaggtcccctggactctccaggagctggaggcgctgctgctgcgttcgcgggatccccgggcaggcccggcggtccccggcggcctgcccaaggacgcgctggccaagctgtcgacgctggtgagccgggcgctggtgcgcatagccaaagaggcgcagcgcctgagcctgcgcttcgccaagtgcaccaagtacgagatccagagcgccatggagatcgtgctgtcctggggcctggccgcgcactgtacggcggctgcgctggccgcactgtccctctacaacatgagcagcgccggcggcgaccgcctgggccgcggcaagtcggcccgctgcggcctcaccttctccgtgggccgcgtgtatcgctggatggtggacagccgcgtggcgctgcgcatccacgagcacgccgccatctacctgacagcctgcatggagagcctcttccgggacatctactcgcgggtcgtggcctccggggtgccccggagctgcagtggccctgggtcaggctcgggctccggcccaggcccgagctcgggccctggtgcggcccccgcggcggataaagagcgggaggcgcccgggggaggagcggcgagcggcggcgcctgcagcgcagccagcagcgccagcgggggcagcagctgttgcgccccgccggccgccgcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgctggggcccgatgggatcaacaccatgagcgaacagggcatgactcccctgatgtatgcctgcgtccgtggggacgaggcgatggttcagatgctgctggatgccggagctgacctgaatgtggaggttgtcagtactcctcataaatatccatccgtccaccccgagacccgccattggacggctctgacttttgctgtgttgcatggacatattcctgtagttcagctcctcctggatgctggggccaaggtggaaggctcagtggagcatggcgaggagaactactcggaaacacccctccagctggcagctgctgtaggaaattttgagctggttagtttgctgttggagcgtggtgccgatcccctgataggaaccatgtacaggaatggaatttctacaaccccccagggtgatatgaactctttcagccaggctgcagcccacggacacaggaatgtgttccgcaaactgctcgcccagccagagaaggagaagagtgatatcctgtccctggaggagattctggccgaggggactgacctggcggagacagccccgccccccttgtgcgccagccgcaacagcaaggccaaactgagggccctgagggaggccatgtatcacagcgctgagcatggctacgtggatgtcacaattgatatcaggagcataggcgtcccgtggactctgcacacgtggctggagtctttgcggatcgccttccagcagcaccgcaggcctctcatccagtgcttgttaaaggagtttaagaccattcaggaggaggaatacacggaggagctcgttacccaaggcctgcccctgatgtttgagatcctgaaagcgagcaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggaggtaagggatccattgtggtgttggctatcataggtcccttgggtgagtggcacttctgtaaactcgggtcaccagcctgcatggaagtgtctggaaggacccgtgttgggttttcatttggatgaagacttggggctcttgttccttcctgactcctcagtcctcccaaacaggaagggcttctcatcagagaccttccctggcaggctggggtgctagtgcacttgcttgcctgactgcttttagtagccactgagtgaaacccaattttaactggcattggtggtaagggggcagggaagggaaggaatttgactgaaaagtctgaggctacagctgaggcgttaatagtgatatcatcaggaaatatcctagatgacgtcttctcccttgtcactaataaaagaattatatcccctaaaaacatccctcaaatcacaacactgtctgttcttccaagatatagaagctgagggcagattacagtctcctcctggctttcctcaaactgagcatcccacagtcatgaagcccacgcctgcttccttcactctccccagccccctgtctgcctcttgtaattcaactggttctagccccgcctgtctaggagtcttgtttctgcctgcttttgtccaaagccaagattttcccctgttccttgccaaaagtggaaatcttgttcattttcctaattgaaactgggagctttgaaccagaagccaaaaatcacccccaattaatcctcagcaaaagagccaggatctcggtcagttatctgacgtctggggggtacctggctgatgagagatgtcaggacacaatcaactgttcaagagcagacctcacacagtggttacaacacggaagctgggccagactagtctaaatccaggctccactgcttctgagctgtgtgactgtggacaagttatttaacctcatatcctcagcttccttacccataaaatggggataactatctacctcactgggttttttagaggatcttaaaatatgctaaggtgcttagaacagtgcctggcacacagtgatcgccaataggactatgtattcactgcaggcccacttatcctttcttcctattctgtgaaaccttccgtggtcactctctccccacccaaacacacacatggacacacagtgactctcttgtctccctggactactcctctgatggttttagtctcgaggatgtgggcttatttgtaaacaaaagtgcgctggtgtttacaactaatttttgtgtgtgtgtgaaacagtctcactctgcccccaggctggagtgcagtggtgcaatttcggctcactgcaacctctgcctcctgggttcacaccattctcctgcctcggcctcccgagtagctaggattacaggcacctgccaccacacccagctaatttgttgtatttttagtagagacggggtttcaccatgttggccagatggtctcgaactcctgacctcagcctcccaaagtgttgggattacaggcatgagccactgcacacggctgtttacaactaactgatcacaaccagttatggatttctgtattccttctccactcccactgcttcatttgtctagccttaacaaaa

SEQ ID NO: 112387 - DNA, 667 bp, Homo sapiens
  Payload ID: 1995
  Gene Symbol: BTBD11
  Gene Name: BTB (POZ) domain containing 11
  ENST ID: ENST00000550706
  CDS Start-End: 1-667
gcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgc

SEQ ID NO: 112388 - DNA, 811 bp, Homo sapiens
  Payload ID: 1995
  Gene Symbol: BTBD11
  Gene Name: BTB (POZ) domain containing 11
  Uniprot ID: A6QL63
  ENST ID: ENST00000494235
  CDS Start-End: 260-811
agcgtttgtctcgttaatggagaacacagtcacaggatcaaaagggctaatttcaggataattctcctgaaatcctgctaatttcaggataattcactgcttccagaattttagagtactggtaaagaatgaagtgatcagccagcagctgtgcgtcatcttcacacactgctacgggccctaccccatccccaagctcacagaaatcaaacggaaacagacctcgcgcttggatcctcattttcttaacaataaagaaatgtctgatgttacatttctggtagaaggaagaccattttatgctcacaaagtgctgttatttacagcctctccaaggttcaaagcactcctctccagcaagccgacaaatgatggcacctgcatagagattggttatgtgaaatactccatctttcagctggttatgcagtatctctactatggtggcccagagtcactgctcattaaaaacaatgagatcatggagcttctgtctgctgctaagtttttccagctggaggctttgcagcgacactgtgagattatctgtgcgaaaagcatcaataccgacaactgtgtggatatttacaaccatgccaagtttcttggagtcacagagctctcagcatattgcgaaggctactttctcaaaaacatgatggtcctcattgaaaacgaagcattcaagcagctcctgtatgacaaaaatggtgaagggaccggccaggatgtgctccaggacttacagaggacgttggccatcagaattcagtccatccacttgtcgtcttccaaaggttccgtggtatga

SEQ ID NO: 112389 - DNA, 1849 bp, Homo sapiens
  Payload ID: 1996
  Gene Symbol: BTBD16
  Gene Name: BTB (POZ) domain containing 16
  Uniprot ID: Q32M84
  ENST ID: ENST00000260723
  CDS Start-End: 252-1772
aggaaaccaaggcaagctccccctgtcaaagcaccttggcccataagaagaaaagggggagccccagatgtgatgagcgcttccaggcttcaggctcagaaggcgcccccagctctcctgtaactcagaggccagtgtgatgggagttcctccactcagcacacttcccctgtaaacacgcctgtggtgggcaaaagggctttggaacggttgcttgtcttttctctcctgcgtaatttccactttcattcatgataatgtcgaacacgcacaaagctcggctggaacgccgggtcactggctcaaccaaccggtggcgtttgcccaaacagcctttctctggggacctgctctcactttcccagatgtgcaaggctctgagcatagactttgaggaagctttgaggaacccagacaggttatgcatttcacaaatccagaagtttttctttgagaatttcaagaacaaggacatccaaagtggggaagcagatgtgattctcgagtgcctgggcttcaaatgggagctccatcagccccagctttttcagtctgagaccttggccaagctctacctgaaagccctggcgcagggcaccacacaccccctgagggagctggaggagcttctgcgagctcaatcacctaagaagaccaaagaaaaatcccctgcaaagaggatcatcatttccttgaagatcaatgacccactggtcactaaagtcgccttcgccacggccctgaagaacctctacatgagtgaggtggagattaacttggaagacctactgggagtgctggcttccgcccacatcctccagttcagtggcctgtttcaaaggtgcgtggatgtgatgatagccagactcaagccaagcaccatcaagaaattctacgaggccggctgcaagtacaaggaagagcagctcaccaccggctgcgagaagtggctggaaatgaacttggttcctctaggggggacgcagatccacctccacaaaatcccacaggacctgctccacaaagtgctgaagtcccccaggttatttacctttagtgaattccatcttctgaaaacaatgcttttgtgggtcttcttgcaactgaactacaagattcaggcaattccgacttatgaaaccgtgatgacattttttaagagctttcctgagaactgttgctttctggaccgggacataggacggagcttgaggccgctcttcctctgcttgcgtctgcacggcatcaccaaaggcaaggatctggaggtgctgcggcaccttaacttcttcccagagtcatggctcgaccaggttacagtcaaccattaccacgcactggagaatgggggcgacatggtccacctgaaagatcttaacacccaggctgtgagatttgggctgctctttaaccaggagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttgacagtttccagaagaatctatgggattttccccccactggtctgcataaaagaaaataaaatgacataaaagggagca

SEQ ID NO: 112390 - DNA, 1805 bp, Homo sapiens
  Payload ID: 1997
  Gene Symbol: BTBD17
  Gene Name: BTB (POZ) domain containing 17
  Uniprot ID: A6NE02
  ENST ID: ENST00000375366
  CDS Start-End: 128-1564
ggagggaggccaagcaggaaggggggtgccgtccccttgtgccggatcctatataaggaagagggatgtgagcagagtggtctgggcttcaccgtccctccagtggacttgggggctgagcataaagatgcctaggagaggctactccaagcctgggtcctggggcagcttctgggccatgctgaccttggtgggcctggtcacccatgcagcacagagagccgatgttggcggggaggcagctggcacctccatcaaccactcccaggcggtgctccagcgcttgcaggagctgctgcggcagggcaacgccagcgatgtggttctgcgggtgcaggctgcgggcaccgatgaggtccgggtattccacgcccaccgcctgctgctgggactgcacagtgagctgttcctggagctgctaagtaaccagagcgaggcggtgctgcaggagccacaggactgcgccgctgtcttcgacaagttcatcaggtacctgtactgcggggagctgaccgtgctgctgacccaggccatccccctgcacagactggccaccaagtacggcgtgtcctccctgcagcgcggcgtggccgactacatgcgcgcgcacctggcgggaggcgcgggcccggcggtgggctggtaccactacgcggtgggcaccggggacgaggccctgcgcgagagctgcctgcagttcctggcctggaacctgtcggccgtggcggccagcaccgagtggggcgccgtgagccccgagctgctctggcagctcctgcaacgctcggacctggtgctgcaggatgaactggagctgttccacgcgctggaggcctggctgggtcgcgcgcggccgccccctgccgtggccgagcgggcgctgcgcgccatacgctaccccatgatcccaccggcacagctgttccagctgcaggcgcgctcggcagccctggcgcgccacggccccgcggtggccgacctcctgctgcaggcctaccagttccacgccgcgtcgccgctgcactacgccaagttcttcgacgtcaacggcagcgccttcctgccccgcaactacctcgcgcccgcctggggcgccccgtgggtcatcaacaacccggcccgcgacgaccgcagcaccagcttccagacgcagctgggcccgagtggccacgacgcgggccgccgggtcacctggaacgtgctcttctcgccgcgctggctgcccgtcagcctgcggcccgtttacgcggacgccgcgggcactgctctgcccgccgcgcgcccggaggacggccgaccgcggctggtggtgacgccggccagcagcggcggcgacgcggcgggcgtgagcttccagaagacggtgctggtgggggcgcgccagcagggccgcctgctggtccgccacgcctacagcttccaccagagcagcgaggaggccggcgacttcctggcgcacgccgacctgcagcggcgcaactccgagtacctggttgagaacgccctgcacctgcacctcatcgtcaagcccgtataccacacccttatccggacccccaagtagcctcggggtctgggaataaaggcctggcctaggtggtccctgtgggtctgggaagggcaaggcgagcctggaggtggcaacaagcctggtcccctggatggccaggcgccggccaccctagggctggggtggagtccaggtgaggcgtggtagacaagatgcctggtttcaagagctgatttcacagctgacttgaaggaacgttcttggtcctgaataaaccgatgctcagagtggtaaa

SEQ ID NO: 112391 - DNA, 3044 bp, Homo sapiens
  Payload ID: 1998
  Gene Symbol: BTBD18
  Gene Name: BTB (POZ) domain containing 18
  Uniprot ID: B2RXH4
  ENST ID: ENST00000422652
  CDS Start-End: 290-2428
aatgtttccttaaaagtgttaacttgaagattatacctgtggagctgggatgtggtgctcaggaagaatataagtagtcagcattgtagcagttgagtctcagtggtaatggaaatgaggaaggttgaaggataataatagttaccatttggggcttggtagttattttgtgccaggcactcactgtgctaagcaactttaccttcactgactcatttaatctttaaaacaaccctacaaggagtctgatctgtgaaaacctagaaggtttgttaagactcttgccaacatgtgctctcctgccagtcccaaaatcctatacaggaacccccggttcctcaggttagcttttctgcagcttcatcaccagcagcagagtgatgtgttctgtgatgtccttctgcaggcagaaggtgaggcagttccagctcactgctgcatcctgtcagcttgtagccccttcttcacagagcgcctggagcgggagaggccagctcagggtgggaaggtggtgctagagctgggtggcctgaagatcagcacacttaggaagctggtggacttcttgtatacctcagaaatggaagtatctcaagaagaagcccaggatgtgctatctgctgcccgtcagctccgtgtgtctgagctggaatcccttcagcttgagggtggaaagttggtgaaggccccacagggccgaaggctgaaccgagagtgcttacaaccaacaagtgctgcaccaatctctgccagagtggtgacacccagccaccaccctcacaccccactgcccactaatcaaactccttgtcctcttggggcaataagattgaagtccttggggaaggaagaggggccccaggaaaacaaccgacagaatgcagacaatttgtctggcactcttctgctcaagaggaaggccagagcctgcccaactccacaagaaaaaaactcttcaccatcaagccatagtcaagagcctagagagaacaagaatgacactgcccttgatcctacagtgctctccccacccagcttgtacccctctgtggacaaacacctgttgcccagaaagatcaggctcagtcgctcaaagccatctcctggtatctgtacatcaaagccttccagcattttaagtggatctagctcagtgcctgcaacccctggccggcgtctttggcggcagaggagtgtaaataaagaaacaccagaggacaagccaaaaccaggcagagctagtcctctgcagagcaccccaaacccatctggtctgggaaagacaggtgggagcaggaagcggagccctgaagtcagggcacctaactcagactctgcagaggaggggcaggttgggagagttaaacttaggaagattgtcaatgggacttgctgggaagtggtacaagagactcctctcaaaaacactcaagatagcccccagatcccagatcccggaggagacttccaagagccttcaggaactcagccattctccagtaatgagcaggaaatgtcacctactagaacagaactgtgtcaggactcccccatgtgcactaagctacaagacattctggtctctgctagccactccccagaccacccagtggtgaagtcagagtttgagtccagtccagaactggtagagaaggaacctatgttggctattgactgcagagaaccctatgcatttgacacagctctgctggagcagccctgtgaggctgaggagtaccgaatcacaagtgctgctgccaccagtgagctggaggagatcctggacttcatgctctgtggctcagacattgaaccacctatagggtctctggagagtccaggggctgagggctgcagaacgcctacctaccatctgacagaaacaggaaagaactggattgaaggggaagaatggtgtctaccagacatggaactctggcccagggagctcacagaattggaaaaggaacctgctggtgagaacagagggccaactgagctccttagcccccttgtcatgccctctgaggtgagtgaagtgctttcagtaggaggccgttggacaccagaccttgaaattaccagctcccagccactggatggtcaggaagacaaacttctccatgtcagctcccttgatactccccagaggtcttatggggacctctcacctccctgctcaaactgggtggagactgggctggaagtctccttgactacagatgagttattatacccttctcccaaggcaggcaaggaggtatctggtcactctgaactactaggctcacttcctgccagctctgaagaggaagagattgatgtggtggactggacagcagaggggaggctggtacccactactgttccctccgtgtggcctgacccttcctcagagtcagaaacagaggtagatatactaacatagtggagaggggagggcaggttaggggccttgggagggtgggaaatgttagctagcaaaaggcttactggcagagaagctggcacgtgccctcagcacaagaggcaggtgtaccctggctctttgtaggtcccttcctcccttccctaagcctcagaagccaggcagaagccaagggtaccatagatagaaaattatgaacttgtaccatcttatttgtaatctattttccggttagtgacaactgaaacaaactgtgtgctccccaattctggtgggtcataggtaacagccaaggccagatctctcaggtcataaggcatccagtcactggtaatttaggaaaagctgagaaagaacaccctcctctgtggtggggtattgtttaagaaaatgttccagaggaaggtgtgaagcagtgttgggtggaatactaagtgggtgggagtgatggatgctgtccagcacccaacgtggggcttattcactgccagtattaggaagtctagctaaaacctctgcaggggccaagaagatgtacttccatcattacttccaaaaagtaagttgaaaaagatacagttgcttttttaaaaaataaattatttactttgctccc

SEQ ID NO: 112392 - DNA, 2947 bp, Homo sapiens
  Payload ID: 1998
  Gene Symbol: BTBD18
  Gene Name: BTB (POZ) domain containing 18
  Uniprot ID: B2RXH4
  ENST ID: ENST00000436147
  CDS Start-End: 189-2327
atatccttggcacaatttctgggctgatgtttcctcaactcatactattatctctcactttcaaaattcccctgccatttcaaagacaaaaaacaaattagatgtaaccatgcctctgaaatgtattatctcacctacaggagtctgatctgtgaaaacctagaaggtttgttaagactcttgccaacatgtgctctcctgccagtcccaaaatcctatacaggaacccccggttcctcaggttagcttttctgcagcttcatcaccagcagcagagtgatgtgttctgtgatgtccttctgcaggcagaaggtgaggcagttccagctcactgctgcatcctgtcagcttgtagccccttcttcacagagcgcctggagcgggagaggccagctcagggtgggaaggtggtgctagagctgggtggcctgaagatcagcacacttaggaagctggtggacttcttgtatacctcagaaatggaagtatctcaagaagaagcccaggatgtgctatctgctgcccgtcagctccgtgtgtctgagctggaatcccttcagcttgagggtggaaagttggtgaaggccccacagggccgaaggctgaaccgagagtgcttacaaccaacaagtgctgcaccaatctctgccagagtggtgacacccagccaccaccctcacaccccactgcccactaatcaaactccttgtcctcttggggcaataagattgaagtccttggggaaggaagaggggccccaggaaaacaaccgacagaatgcagacaatttgtctggcactcttctgctcaagaggaaggccagagcctgcccaactccacaagaaaaaaactcttcaccatcaagccatagtcaagagcctagagagaacaagaatgacactgcccttgatcctacagtgctctccccacccagcttgtacccctctgtggacaaacacctgttgcccagaaagatcaggctcagtcgctcaaagccatctcctggtatctgtacatcaaagccttccagcattttaagtggatctagctcagtgcctgcaacccctggccggcgtctttggcggcagaggagtgtaaataaagaaacaccagaggacaagccaaaaccaggcagagctagtcctctgcagagcaccccaaacccatctggtctgggaaagacaggtgggagcaggaagcggagccctgaagtcagggcacctaactcagactctgcagaggaggggcaggttgggagagttaaacttaggaagattgtcaatgggacttgctgggaagtggtacaagagactcctctcaaaaacactcaagatagcccccagatcccagatcccggaggagacttccaagagccttcaggaactcagccattctccagtaatgagcaggaaatgtcacctactagaacagaactgtgtcaggactcccccatgtgcactaagctacaagacattctggtctctgctagccactccccagaccacccagtggtgaagtcagagtttgagtccagtccagaactggtagagaaggaacctatgttggctattgactgcagagaaccctatgcatttgacacagctctgctggagcagccctgtgaggctgaggagtaccgaatcacaagtgctgctgccaccagtgagctggaggagatcctggacttcatgctctgtggctcagacattgaaccacctatagggtctctggagagtccaggggctgagggctgcagaacgcctacctaccatctgacagaaacaggaaagaactggattgaaggggaagaatggtgtctaccagacatggaactctggcccagggagctcacagaattggaaaaggaacctgctggtgagaacagagggccaactgagctccttagcccccttgtcatgccctctgaggtgagtgaagtgctttcagtaggaggccgttggacaccagaccttgaaattaccagctcccagccactggatggtcaggaagacaaacttctccatgtcagctcccttgatactccccagaggtcttatggggacctctcacctccctgctcaaactgggtggagactgggctggaagtctccttgactacagatgagttattatacccttctcccaaggcaggcaaggaggtatctggtcactctgaactactaggctcacttcctgccagctctgaagaggaagagattgatgtggtggactggacagcagaggggaggctggtacccactactgttccctccgtgtggcctgacccttcctcagagtcagaaacagaggtagatatactaacatagtggagaggggagggcaggttaggggccttgggagggtgggaaatgttagctagcaaaaggcttactggcagagaagctggcacgtgccctcagcacaagaggcaggtgtaccctggctctttgtaggtcccttcctcccttccctaagcctcagaagccaggcagaagccaagggtaccatagatagaaaattatgaacttgtaccatcttatttgtaatctattttccggttagtgacaactgaaacaaactgtgtgctccccaattctggtgggtcataggtaacagccaaggccagatctctcaggtcataaggcatccagtcactggtaatttaggaaaagctgagaaagaacaccctcctctgtggtggggtattgtttaagaaaatgttccagaggaaggtgtgaagcagtgttgggtggaatactaagtgggtgggagtgatggatgctgtccagcacccaacgtggggcttattcactgccagtattaggaagtctagctaaaacctctgcaggggccaagaagatgtacttccatcattacttccaaaaagtaagttgaaaaagatacagttgcttttttaaaaaataaattatttactttgctcccataa

SEQ ID NO: 112393 - DNA, 557 bp, Homo sapiens
  Payload ID: 1998
  Gene Symbol: BTBD18
  Gene Name: BTB (POZ) domain containing 18
  ENST ID: ENST00000527995
  CDS Start-End: 290-557
aatgtttccttaaaagtgttaacttgaagattatacctgtggagctgggatgtggtgctcaggaagaatataagtagtcagcattgtagcagttgagtctcagtggtaatggaaatgaggaaggttgaaggataataatagttaccatttggggcttggtagttattttgtgccaggcactcactgtgctaagcaactttaccttcactgactcatttaatctttaaaacaaccctacaaggagtctgatctgtgaaaacctagaaggtttgttaagactcttgccaacatgtgctctcctgccagtcccaaaatcctatacaggaacccccggttcctcaggttagcttttctgcagcttcatcaccagcagcagagtgatgtgttctgtgatgtccttctgcaggcagaaggtgaggcagttccagctcactgctgcatcctgtcagcttgtagccccttcttcacagagcgcctggagcgggagaggccagctcagggtgggaaggtggtgctagagctgggtggcctgaagatcagcacacttaggaagctgg

SEQ ID NO: 112394 - DNA, 1214 bp, Homo sapiens
  Payload ID: 1999
  Gene Symbol: BTBD19
  Gene Name: BTB (POZ) domain containing 19
  ENST ID: ENST00000409335
  CDS Start-End: 299-1060
agggcctctttcgccgccgccgccgccgccagccagccagcttcttcccaggaccataggccactccagcctcagcttctcctggccccctccctgtgtctgttcctgtccccgagcctctggcctctgatgccttcaggagcttgggcctctcctgctccactcctaaacttcagcttctcagcaaacaggcctcccaagtccctgcttctccctctcaggccttgctaacctcaccagctctagggcctggccaggcctcccaggctccctcctccaccccaaccccttctcactcatggagcccttgggactggtcgtgcatgggaaagctgaacctttttccgcagcactccgaagccttgtcaacaacccgcgatacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtggccgtaacctttggcctggggcagctgcaggagcgctgcgtggctttcatagaggcccacagccaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggcggtgctggagcggccggtggctgaggtggcggccccggtggtgaaagagctgagactagccttgctggccccggcggagctgagcgccctggaagagcagaaccggcaggaaccactcatcccggtggagcagattgtggaggcgtggaaatgccatgccctgcggagaggggatgaggcccggggcgccccgtgtcgccgccggagaggcaccctgccccgggagcatcaccgctttctggacctgtccttcaaatgatccaacgccgggactcgcagggagccctcgacccgcccagctgagcctgccccaaactacagctcccgaagtgctcggcgttcggagcgggcttccgttcccagcgtgcccagtgagccgggcgccggaagaaccgttgtctgccacgcgcagc

SEQ ID NO: 112395 - DNA, 1572 bp, Homo sapiens
  Payload ID: 1999
  Gene Symbol: BTBD19
  Gene Name: BTB (POZ) domain containing 19
  Uniprot ID: C9JJ37
  ENST ID: ENST00000450269
  CDS Start-End: 340-1215
aggcttcccaccccgtcggctgcctgggcagactcccagccagggcctctttcgccgccgccgccgccgccagccagccagcttcttcccaggaccataggccactccagcctcagcttctcctggccccctccctgtgtctgttcctgtccccgagcctctggcctctgatgccttcaggagcttgggcctctcctgctccactcctaaacttcagcttctcagcaaacaggcctcccaagtccctgcttctccctctcaggccttgctaacctcaccagctctagggcctggccaggcctcccaggctccctcctccaccccaaccccttctcactcatggagcccttgggactggtcgtgcatgggaaagctgaacctttttccgcagcactccgaagccttgtcaacaacccgcgatacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgctggaagtgctgacagcggctgtggagtatgggctggaggaactgagagagctgtgcctgcagtttgtggtgaaggtgctggatgtggacttggtttgtgaggccctgcaggtggccgtaacctttggcctggggcagctgcaggagcgctgcgtggctttcatagaggcccacagccaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggcggtgctggagcggccggtggctgaggtggcggccccggtggtgaaagagctgagactagccttgctggccccggcggagctgagcgccctggaagagcagaaccggcaggaaccactcatcccggtggagcagattgtggaggcgtggaaatgccatgccctgcggagaggggatgaggcccggggcgccccgtgtcgccgccggagaggcaccctgccccgggagcatcaccgctttctggacctgtccttcaaatgatccaacgccgggactcgcagggagccctcgacccgcccagctgagcctgccccaaactacagctcccgaagtgctcggcgttcggagcgggcttccgttcccagcgtgcccagtgagccgggcgccggaagaaccgttgtctgccacgcgcagccccttgtgcgggatcaagcccgtgtgggcgaggtggggtcgggccgggcagggcttgggctgggcctccctgagggggtgaaactcgaaaacgaggatttccttcgttccacaccctgactctacgccctgcccctgggcattgtcgtctactagtctattctgatgactcccacatatctatctgttcagctcagctccctc

SEQ ID NO: 112396 - DNA, 941 bp, Homo sapiens
  Payload ID: 1999
  Gene Symbol: BTBD19
  Gene Name: BTB (POZ) domain containing 19
  Uniprot ID: C9JJ37
  ENST ID: ENST00000439563
  CDS Start-End: 255-743
ttcccaggaccataggccactccagcctcagcttctcctggccccctccctgtgtctgttcctgtccccgagcctctggcctctgatgccttcaggagcttgggcctctcctgctccactcctaaacttcagcttctcagcaaacaggcctcccaagtccctgcttctccctctcaggccttgctaacctcaccagctctagggcctggccaggcctcccaggctccctcctccaccccaaccccttctcactcatggagcccttgggactggtcgtgcatgggaaagctgaacctttttccgcagcactccgaagccttgtcaacaacccgcgatacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgctggaagtgctgacagcggctgtggagtatgggctggaggaactgagagagctgtgcctgcagtttgtggtgaaggtgctggatgtggacttggtttgtgaggccctgcagcacttttggaggccgaggcgggcggatcaagaggtcaggagatcgagaccatcctggctaacacggtggccgtaacctttggcctggggcagctgcaggagcgctgcgtggctttcatagaggcccacagccaggaggccctccggacccgaggcttcctggagctgtcggcggccgcgctgctgcccctgctccgcagcgacaagctctgcgtggacgaggctgaactggtccgcgcggcccgaagctgggcgcgcgtgggcgcggtgagtg

SEQ ID NO: 112397 - DNA, 2649 bp, Homo sapiens
  Payload ID: 2000
  Gene Symbol: BTBD2
  Gene Name: BTB (POZ) domain containing 2
  Uniprot ID: Q9BX70
  ENST ID: ENST00000255608
  CDS Start-End: 22-1599
cgcccacgccgcagccacaaaatggcggcgggtgggagcggcgggcgtgcgtcgtgcccgccgggggtcggggtcggcccgggcacggggggcagtcccgggcccagcgccaacgccgccgccaccccggcccccggcaacgcggccgccgccgccgccgccgccgccgccgccgccgccgcccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggcccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgccttgagcgca

SEQ ID NO: 112398 - DNA, 858 bp, Homo sapiens
  Payload ID: 2000
  Gene Symbol: BTBD2
  Gene Name: BTB (POZ) domain containing 2
  ENST ID: ENST00000589200
  CDS Start-End: 1-335
ccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacagggaccctgccactcccacccgcacccctgtgcgccaagacccctaggccttgctccctgcgtcctccctgctgcctccagacccagtgacccccaccggagacccccaggctcagcacatgatctggatcagagaccttcaaaccatgctgctcccctccagggataccccctgcccgccctgcagtccagatcatagactaccatccacagcccctccagccccggacccccacctcagccagagacccctgggccctgccacctcccacttcagtgaccacccacctccagctccgccactgccaggctctggaccctggactctgcagaaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcagg

SEQ ID NO: 112399 - DNA, 961 bp, Homo sapiens
  Payload ID: 2000
  Gene Symbol: BTBD2
  Gene Name: BTB (POZ) domain containing 2
  ENST ID: ENST00000587825
  CDS Start-End: 1-961
gttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggctggagtgcaatggcacgatctcagctcactgcaacctccgcctccagcgttcaagcgattctcctgcctcagcctccacagtagctgggattacaggcccccaccaccgcgcctggctaaaaaaaaagaaaaaaaaaaaccagagagaactttctctctctctctaaggaaatgtcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtat

SEQ ID NO: 112400 - DNA, 352 bp, Homo sapiens
  Payload ID: 2000
  Gene Symbol: BTBD2
  Gene Name: BTB (POZ) domain containing 2
  ENST ID: ENST00000588395
  CDS Start-End: 278-352
aagagagatggcgctcgggacggaagggttccctgccctgccccaggagcctgcatgggagaaggcgtgaggaggtgaaggaagcttatggtacctgcacaccgacaggctggagcgcgagagatcttgctctgttgcccaggctggagggcagtggtggagtcatagctcatcaaaagctcaaccttccaggctcaagtgatgcttccgtctcagccttctgagtagctgggacaacaggttcgtgctggccgtgggcagcgccgtctttgatgccatgttcaacgggggaatggccacaacatccacggagattgagctgcccgacgtggaacccgctgccttcctcgca

SEQ ID NO: 112401 - DNA, 349 bp, Homo sapiens
  Payload ID: 2000
  Gene Symbol: BTBD2
  Gene Name: BTB (POZ) domain containing 2
  ENST ID: ENST00000592082
  CDS Start-End: 1-349
gttcaatgccgttgtccgctggtccgaggccgagtgtcagcggcagcagctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccg

SEQ ID NO: 112402 - DNA, 572 bp, Homo sapiens
  Payload ID: 2000
  Gene Symbol: BTBD2
  Gene Name: BTB (POZ) domain containing 2
  ENST ID: ENST00000590646
  CDS Start-End: 414-572
gctggaggcaagagagatggcgctcgggacggaagggttccctgccctgccccaggagcctgcatgggagaaggcgtgaggaggtgaaggaagcttatggtacctgcacaccgacaggctggagcgcgagagcaaccctgtggcctgtcctggtctctgactcaccctgaagaatgagaaacctgtttaaagtgaagtgtgatggaatcaagtcagacgtgaggaaggacctacctccttggtcaaagctgggatggggatcttgctctgttgcccaggctggagggcagtggtggagtcatagctcatcaaaagctcaaccttccaggctcaagtgatgcttccgtctcagccttctgagtagctgggacaacaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtgcagattggcccggagacggtgatgaccacgctatacaccgccaagaagtacgcg

SEQ ID NO: 112403 - DNA, 559 bp, Homo sapiens
  Payload ID: 2000
  Gene Symbol: BTBD2
  Gene Name: BTB (POZ) domain containing 2
  ENST ID: ENST00000587742
  CDS Start-End: 455-559
aagagagatggcgctcgggacggaagggttccctgccctgccccaggagcctgcatgggagaaggcgtgaggaggtgaaggaagcttatggtacctgcacaccgacaggctggagcgcgagagcaaccctgtggcctgtcctggtctctgactcaccctgaagaatgagaaacctgtttaaagtgaagtgtgatggaatcaagtcagacgtgaggaaggacctacctccttggtcaaagctgggatggggatcttgctctgttgcccaggctggagggcagtggtggagtcatagctcatcaaaagctcaaccttccaggctcaagtgatgcttccgtctcagccttctgagtagctgggacaacaggctggagtgcaatggcgcggtctcggctcactgcaacctccgcctcccaggttcgtgctggccgtgggcagcgccgtctttgatgccatgttcaacgggggaatggccacaacatccacggagattgagctgcccgacgtggaacccgctgccttcctcgcactgctcaagtttctctactcggacgaggtg

SEQ ID NO: 112404 - DNA, 4686 bp, Homo sapiens
  Payload ID: 2001
  Gene Symbol: BTBD3
  Gene Name: BTB (POZ) domain containing 3
  Uniprot ID: Q9Y2F9
  ENST ID: ENST00000254977
  CDS Start-End: 358-1743
attgcgcatgccccgtatccaaggccgcctccgggagcacctcccatgccgctccgctccctcccggtgaccgggcacgcgcgctcgctcccgcagagcgtgccctgcgtgcgggtgcccgccgagcccgccgggcgctggatctccgagtgccccggccggggcctgaggagcgggcacagggcaaggcggcggacggctgcgtcgcccgaggcgaggaggagcgctggcgagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagccacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcatagatttgttttccttta

SEQ ID NO: 112405 - DNA, 4904 bp, Homo sapiens
  Payload ID: 2001
  Gene Symbol: BTBD3
  Gene Name: BTB (POZ) domain containing 3
  Uniprot ID: Q9Y2F9
  ENST ID: ENST00000378226
  CDS Start-End: 412-1980
gtaatacctactctcctccgatccattcaccacacaacttcagccggctgaacagactcacgcagctccagcccatcttgctgacctaattcagaaaagaagtgctacagctctgtgcctgtcatctttgcagtgtagcattttcaggtgatctaggaaacagttatttttatgagcaaataagagaaacaggaatcatgatggggatatatttaacagacccagtactggataaaacttaaagccagtttctattcaacatagtgaaaaggtcaccttgcctggctgagaaaagcagcaaaatatcagctttgttggtttcagttaacctcttagcccgggctaatctcttttccttgatgttcaaaccaatttgggatatctaactctaaagagagacacactgtactcatggtagatgacaaggaaaagaacatgaaatgtctcaccttcttcttgatgcttccagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagccacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttc

SEQ ID NO: 112406 - DNA, 4826 bp, Homo sapiens
  Payload ID: 2001
  Gene Symbol: BTBD3
  Gene Name: BTB (POZ) domain containing 3
  Uniprot ID: Q9Y2F9
  ENST ID: ENST00000399006
  CDS Start-End: 498-1883
agagcgtgccctgcgtgcgggtgcccgccgagcccgccgggcgctggatctccgagtgccccggccggggcctgaggagcgggcacagggcaaggcggcggacggctgcgtcgcccgaggcgaggaggagcgctggcggtgtcactgttttgcttggtccaatcatgattggtgacttcagctattggctcggagcactggctgtctgactccatctgcagggctgtaatacctactctcctccgatccattcaccacacaacttcagccggctgaacagactcacgcagctccagcccatcttgctgacctaattcagaaaagaagtgctacagctctgtgcctgtcatctttgcagtgtagcattttcagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagccacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcatagatttgttttccttta

SEQ ID NO: 112407 - DNA, 5137 bp, Homo sapiens
  Payload ID: 2001
  Gene Symbol: BTBD3
  Gene Name: BTB (POZ) domain containing 3
  Uniprot ID: Q9Y2F9
  ENST ID: ENST00000405977
  CDS Start-End: 626-2194
tgcgtgcgggtgcccgccgagcccgccgggcgctggatctccgagtgccccggccggggcctgaggagcgggcacagggcaaggcggcggacggctgcgtcgcccgaggcgaggaggagcgctggcggtgtcactgttttgcttggtccaatcatgattggtgacttcagctattggctcggagcactggctgtctgactccatctgcagggctgtaatacctactctcctccgatccattcaccacacaacttcagccggctgaacagactcacgcagctccagcccatcttgctgacctaattcagaaaagaagtgctacagctctgtgcctgtcatctttgcagtgtagcattttcaggtgatctaggaaacagttatttttatgagcaaataagagaaacaggaatcatgatggggatatatttaacagacccagtactggataaaacttaaagccagtttctattcaacatagtgaaaaggtcaccttgcctggctgagaaaagcagcaaaatatcagctttgttggtttcagttaacctcttagcccgggctaatctcttttccttgatgttcaaaccaatttgggatatctaactctaaagagagacacactgtactcatggtagatgacaaggaaaagaacatgaaatgtctcaccttcttcttgatgcttccagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagccacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcatagatttgttttccttta

SEQ ID NO: 112408 - DNA, 583 bp, Homo sapiens
  Payload ID: 2001
  Gene Symbol: BTBD3
  Gene Name: BTB (POZ) domain containing 3
  ENST ID: ENST00000422390
  CDS Start-End: 177-583
cttttcggaagaatttttgaatcaccctttttcatttcttggcctcagcagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacact

SEQ ID NO: 112409 - DNA, 485 bp, Homo sapiens
  Payload ID: 2001
  Gene Symbol: BTBD3
  Gene Name: BTB (POZ) domain containing 3
  ENST ID: ENST00000450368
  CDS Start-End: 481-485
ggaggtggcggaggtccaggcagggggcgcggtcgggaagcctcggcgcctagcaggtggcgggggccgcgcccctctcccggggaggcgcgcggtgggaagcggagcaaacttcccctaagtgtcactgttttgcttggtccaatcatgattggtgacttcagctattggctcggagcactggctgtctgactccatctgcagggctgtaatacctactctcctccgatccattcaccacacaacttcagccggctgaacagactcacgcagctccagcccatcttgctgacctaattcagaaaagaagtgctacagctctgtgcctgtcatctttgcagtgtagcattttcagagacggtaaagaacaggtccaagaaaagctcaaagaaagcaaataccagcagcagcagtagcaacagcagcaagttgccaccagtttgttatgaaataattaccttgaagactaaaaagaagaagatggc

SEQ ID NO: 112410 - DNA, 541 bp, Homo sapiens
  Payload ID: 2001
  Gene Symbol: BTBD3
  Gene Name: BTB (POZ) domain containing 3
  ENST ID: ENST00000430557
  CDS Start-End: 243-541
tttatttgtccttagctttattaaaagtttgtataacttttattttaaactttagttacttcccttatgtttgcaatgattatgaacagtttagttagaacctttatttgttgttttgccttgaagttactggactgttgcttagcttgcaagtcttttgtgggttttgtatgttggggaaggggatgttaaaaatgcaggctgctgtgaattaatgagttgcctctgtttatagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagc

SEQ ID NO: 112411 - DNA, 493 bp, Homo sapiens
  Payload ID: 2001
  Gene Symbol: BTBD3
  Gene Name: BTB (POZ) domain containing 3
  ENST ID: ENST00000455911
  CDS Start-End: 75-493
aagtgacagggttgtctatgggccatagaaaatgggaaccttttatttgtccttagctttattaaaaaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgccca

SEQ ID NO: 112412 - DNA, 849 bp, Homo sapiens
  Payload ID: 2001
  Gene Symbol: BTBD3
  Gene Name: BTB (POZ) domain containing 3
  ENST ID: ENST00000449299
  CDS Start-End: 211-363
gagtgccccggccggggcctgaggagcgggcacagggcaaggcggcggacggctgcgtcgcccgaggcgaggaggagcgctggcgagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagtatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttga

SEQ ID NO: 112413 - DNA, 4582 bp, Homo sapiens
  Payload ID: 2001
  Gene Symbol: BTBD3
  Gene Name: BTB (POZ) domain containing 3
  Uniprot ID: Q9Y2F9
  ENST ID: ENST00000618296
  CDS Start-End: 273-1658
gtaatacctactctcctccgatccattcaccacacaacttcagccggctgaacagactcacgcagctccagcccatcttgctgacctaattcagaaaagaagtgctacagctctgtgcctgtcatctttgcagtgtagcattttcagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagccacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttc

SEQ ID NO: 112414 - DNA, 4486 bp, Homo sapiens
  Payload ID: 2001
  Gene Symbol: BTBD3
  Gene Name: BTB (POZ) domain containing 3
  Uniprot ID: Q9Y2F9
  ENST ID: ENST00000618918
  CDS Start-End: 177-1562
cttttcggaagaatttttgaatcaccctttttcatttcttggcctcagcagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacgttctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaataatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagccacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttc

SEQ ID NO: 112415 - DNA, 1948 bp, Homo sapiens
  Payload ID: 2002
  Gene Symbol: BTBD6
  Gene Name: BTB (POZ) domain containing 6
  Uniprot ID: Q96KE9
  ENST ID: ENST00000327471
  CDS Start-End: 304-1536
agcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgcccacactcggcaacaaccaccaggagagccccggctggcggtgctgccgccccacgctgcgcgagaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcct

SEQ ID NO: 112416 - DNA, 2176 bp, Homo sapiens
  Payload ID: 2002
  Gene Symbol: BTBD6
  Gene Name: BTB (POZ) domain containing 6
  Uniprot ID: Q96KE9
  ENST ID: ENST00000392554
  CDS Start-End: 298-1755
cgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataaca

SEQ ID NO: 112417 - DNA, 2195 bp, Homo sapiens
  Payload ID: 2002
  Gene Symbol: BTBD6
  Gene Name: BTB (POZ) domain containing 6
  Uniprot ID: Q96KE9
  ENST ID: ENST00000463376
  CDS Start-End: 542-1774
ctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggtgagcccgtgccccgcggcccccgcgcccgcgcgcgcccacgcccccagcccgtgcctctacctttgcaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataaca

SEQ ID NO: 112418 - DNA, 1973 bp, Homo sapiens
  Payload ID: 2002
  Gene Symbol: BTBD6
  Gene Name: BTB (POZ) domain containing 6
  Uniprot ID: Q96KE9
  ENST ID: ENST00000536364
  CDS Start-End: 104-1561
cggggccgcggcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcct

SEQ ID NO: 112419 - DNA, 1335 bp, Homo sapiens
  Payload ID: 2002
  Gene Symbol: BTBD6
  Gene Name: BTB (POZ) domain containing 6
  ENST ID: ENST00000537513
  CDS Start-End: 113-1335
gtgacgcaccggcgccgcggcggagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcaga

SEQ ID NO: 112420 - DNA, 2621 bp, Homo sapiens
  Payload ID: 2003
  Gene Symbol: BTBD7
  Gene Name: BTB (POZ) domain containing 7
  Uniprot ID: Q9P203
  ENST ID: ENST00000298896
  CDS Start-End: 380-1612
ggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaagaggagactacagtcatcaggcctgcctgtgcagcagagctttcaaacagctgcttactgcctcaatcttaaatatgaaaacccatccaaggataactggacatttgaggaaagcttccaaattgagacagagatcagagcaaaaagaacaaagtcctggaggaagcagacaatgaagggagcagaagaaaacttcagtagaatcaaaatatccttatataaaagaactttttatggaatcagtgagacataagcaggatgctattaaagtaaaaacaggagcttttagaaataagatagcagaaatgaaagatataatggaagcattgaaaggtacagttgaggaaatctagaaagtaaataatataataaagagatgagtggagacaaataaaactagagtattcatccagggtctaacatctaacaaatagtggctttagaaatatataccagagaaaagtgaagagaagacagtatctaaggagtaatataagaaatatttccaaaactaaaggaatttctatataaaaagtttctttttcagaacactggggaaaaagagacaattttaaaatgttgcagggaggagaaaaattaggttccatgcaaagaaataggaatcagatggtattgagattttcagtagcaacaactgaataccacaatacagtgaagtagtgtcttccaaaagctgatggaaaattattttaaacacaaaatcctatatttagccaaacagtcaatcaagtgtaaggctaaataaaggcatttttcagtcatacctcgaaaaactgcctgtgtagggatatttcccctgcttccccactcaggcagctgctgggaatgtattccaccaaatgacgaagcaaaccaagaacaaagaagtgaaggatctagaaaatgggctccaacacgggaaggaagcaaagggagatcccacgcatcagccacacagtaggtcttgtgggcattcagtctagcccagaccgggagggtgaaagtctccaaggaaagaggtgtctcggaagaaatcaattactttcaatgtttgaacattaaatagcaaatgacaaagcaa

SEQ ID NO: 112421 - DNA, 8430 bp, Homo sapiens
  Payload ID: 2003
  Gene Symbol: BTBD7
  Gene Name: BTB (POZ) domain containing 7
  Uniprot ID: Q9P203
  ENST ID: ENST00000334746
  CDS Start-End: 309-3707
gtcaaaatggcggcgaggggaacctggagcagtcccggagcctgagccactgacaggagaggagagggcggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaa

SEQ ID NO: 112422 - DNA, 6822 bp, Homo sapiens
  Payload ID: 2003
  Gene Symbol: BTBD7
  Gene Name: BTB (POZ) domain containing 7
  ENST ID: ENST00000355125
  CDS Start-End: 1-79
gaccagggcagaagaagccatggaactttaccacatagcactgttcttggaatttaacatgcttgcacaaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaa

SEQ ID NO: 112423 - DNA, 316 bp, Homo sapiens
  Payload ID: 2003
  Gene Symbol: BTBD7
  Gene Name: BTB (POZ) domain containing 7
  ENST ID: ENST00000554968
  CDS Start-End: 150-316
aggcctgaggactgctactcccaggggaagttagattgtccggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaa

SEQ ID NO: 112424 - DNA, 2479 bp, Homo sapiens
  Payload ID: 2003
  Gene Symbol: BTBD7
  Gene Name: BTB (POZ) domain containing 7
  ENST ID: ENST00000553975
  CDS Start-End: 1-2244
ttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcat

SEQ ID NO: 112425 - DNA, 2697 bp, Homo sapiens
  Payload ID: 2003
  Gene Symbol: BTBD7
  Gene Name: BTB (POZ) domain containing 7
  Uniprot ID: Q9P203
  ENST ID: ENST00000554565
  CDS Start-End: 112-2457
ctcctgctccgtctaggagtcaaaatggcggcgaggggaacctggagcagtcccggagcctgagccactgacaggagaggagagggcggcggcggcggcggtgggaggaggatggccgggggtgctggcgccggtgcggacggcggtgctggtggcggcggcggcggaggcgacggcagcggtcccagcggcagcagcagcggcgggaggagcctccggggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcattttta

SEQ ID NO: 112426 - DNA, 2328 bp, Homo sapiens
  Payload ID: 2003
  Gene Symbol: BTBD7
  Gene Name: BTB (POZ) domain containing 7
  ENST ID: ENST00000555525
  CDS Start-End: 108-1544
gaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaagcttgccttccatttgttttacagaggagactacagtcatcaggcctgcctgtgcagcagagctttcaaacagctgcttactgcctcaatcttaaatatgaaaacccatccaaggataactggacatttgaggaaagcttccaaattgagacagagatcagagcaaaaagaacaaagtcctggaggaagcagacaatgaagggagcagaagaaaacttcagtagaatcaaaatatccttatataaaagaactttttatggaatcagtgagacataagcaggatgctattaaagtaaaaacaggagcttttagaaataagatagcagaaatgaaagatataatggaagcattgaaaggtacagttgaggaaatctagaaagtaaataatataataaagagatgagtggagacaaataaaactagagtattcatccagggtctaacatctaacaaatagtggctttagaaatatataccagagaaaagtgaagagaagacagtatctaaggagtaatataagaaatatttccaaaactaaaggaatttctatataaaaagtttctttttcagaacactggggaaaaagagacaattttaaaatgttgcagggaggagaaaaattaggttccatgcaaagaaataggaatcagatggtattgagattttcagtagcaacaactgaataccacaatacagtgaagtagtgtcttccaaaagctgatggaaaattattttaaacacaaaatcctatatttagccaaacagtcaatcaagtgtaaggctaaataaaggcatttttcagtcatacctcgaaaaactgcctgtgtagggatatttcccctgcttccccactcaggcagctgctgggaatgtattccaccaaatgacgaagcaaaccaagaacaaagaagtgaaggatctagaaaatgggctccaacacgggaaggaagcaaagggagatcccacgcatcagccacacagtaggtcttgtgggcattcagtctagcccagaccgggagggtgaaagtctccaaggaaagaggtgtctcggaagaaatca

SEQ ID NO: 112427 - DNA, 6822 bp, Homo sapiens; identical to SEQ ID NO: 112422
  Payload ID: 2003
  Gene Symbol: BTBD7
  Gene Name: BTB (POZ) domain containing 7
  ENST ID: ENST00000620259
  CDS Start-End: 1-79

SEQ ID NO: 112428 - DNA, 8430 bp, Homo sapiens; identical to SEQ ID NO: 112421
  Payload ID: 2003
  Gene Symbol: BTBD7
  Gene Name: BTB (POZ) domain containing 7
  Uniprot ID: Q9P203
  ENST ID: ENST00000613725
  CDS Start-End: 309-3707

SEQ ID NO: 112429 - DNA, 2621 bp, Homo sapiens; identical to SEQ ID NO: 112420
  Payload ID: 2003
  Gene Symbol: BTBD7
  Gene Name: BTB (POZ) domain containing 7
  Uniprot ID: Q9P203
  ENST ID: ENST00000613511
  CDS Start-End: 380-1612

SEQ ID NO: 112430 - DNA, 2479 bp, Homo sapiens; identical to SEQ ID NO: 112424
  Payload ID: 2003
  Gene Symbol: BTBD7
  Gene Name: BTB (POZ) domain containing 7
  ENST ID: ENST00000628944
  CDS Start-End: 1-2244

SEQ ID NO: 112431 - DNA, 2697 bp, Homo sapiens; identical to SEQ ID NO: 112425
  Payload ID: 2003
  Gene Symbol: BTBD7
  Gene Name: BTB (POZ) domain containing 7
  Uniprot ID: Q9P203
  ENST ID: ENST00000627779
  CDS Start-End: 112-2457

SEQ ID NO: 112432 - DNA, 316 bp, Homo sapiens; identical to SEQ ID NO: 112423
  Payload ID: 2003
  Gene Symbol: BTBD7
  Gene Name: BTB (POZ) domain containing 7
  ENST ID: ENST00000626573
  CDS Start-End: 150-316

SEQ ID NO: 112433 - DNA, 2328 bp, Homo sapiens; identical to SEQ ID NO: 112426
  Payload ID: 2003
  Gene Symbol: BTBD7
  Gene Name: BTB (POZ) domain containing 7
  ENST ID: ENST00000625801
  CDS Start-End: 108-1544

SEQ ID NO: 112434 - DNA, 1408 bp, Homo sapiens
  Payload ID: 2004
  Gene Symbol: BTBD8
  Gene Name: BTB (POZ) domain containing 8
  Uniprot ID: Q5XKL5
  ENST ID: ENST00000342818
  CDS Start-End: 237-1373
gcgcacgctcttcctgggtcaagagccggctcggttctgggattctgaggctccccaccgcggtccggcttctctgggagactgtctacaaaccgacgagaggcgtcaaccttttaccctagggggcggatttgggtaggagccgagcgttcggtcggaaacgcccccttcttcctcctgggcggggcaagtgaggccaagtactgggcctccagggcgtcgtacctctgtgagacatggctcgctgtggggaaggcagtgcggcccccatggtacttctggggtccgctggagtttgcagtaaggggttgcaaaggaaggggccgtgtgagcggcgccggctgaaggcgacggtgtcggagcagctcagccaggatttgctcaggcttctaagggaagaattccatacagatgttaccttctctgtgggttgtactttgttcaaagcacacaaagcagtccttttagcaagagttcctgacttctattttcatactattggacagacatcaaatagtttaacaaatcaggagcctattgctgtggagaatgttgaagctttagaatttagaacgtttttacagattatatattcatcaaacagaaacataaaaaactatgaagaggaaattcttaggaaaaagataatggagattgggatatcacaaaagcaacttgacatcagttttccaaagtgtgaaaactcatctgattgttctcttcagaagcatgaaattccagaggatatcagtgacagagatgatgatttcatttccaatgataattatgacttggagcctgcatctgaattaggagaagatttattgaagctttatgtgaaaccttgttgcccagatattgatatttttgttgatggaaaacgttttaaagctcacagggccattttgagtgccagatctagttattttgctgcaatgctgagtggctgttgggctgaaagctcccaagagtacgttactcttcaaggtataagccatgtagaactgaatgttatgatgcattttatatatggaggaactctggacattccagacaaaactaatgttggtcagatactcaatatggctgatatgtatggactagaaggattaaaagaagtagcaatctatattttaagaagagattactgtaatttctttcagaagcctgttcccagaacattgacgtctatactagaatgcctgattattgctcattcagttggagtggaaagtctttttgctgactgcatgaagtggattgtaaagcattttgcaaggttttggtctgagagaagctttgcaaatatacctcctgagattcagaaaagttgtcttaatatgttgattcagtccttagtaagtataacctgaatactcttttgtgtgtttgccattaaaaagtttat

SEQ ID NO: 112435 - DNA, 1616 bp, Homo sapiens
  Payload ID: 2004
  Gene Symbol: BTBD8
  Gene Name: BTB (POZ) domain containing 8
  Uniprot ID: Q5XKL5
  ENST ID: ENST00000370382
  CDS Start-End: 268-1185
gccggcagaagtaaacagagcgagtacgcctgcgcacgctcttcctgggtcaagagccggctcggttctgggattctgaggctccccaccgcggtccggcttctctgggagactgtctacaaaccgacgagaggcgtcaaccttttaccctagggggcggatttgggtaggagccgagcgttcggtcggaaacgcccccttcttcctcctgggcggggcaagtgaggccaagtactgggcctccagggcgtcgtacctctgtgagacatggctcgctgtggggaaggcagtgcggcccccatggtacttctggggtccgctggagtttgcagtaaggggttgcaaaggaaggggccgtgtgagcggcgccggctgaaggcgacggtgtcggagcagctcagccaggatttgctcaggcttctaagggaagaattccatacagatgttaccttctctgtgggttgtactttgttcaaagcacacaaagcagtccttttagcaagagttcctgacttctattttcatactattggacagacatcaaatagtttaacaaatcaggagcctattgctgtggagaatgttgaagctttagaatttagaacgtttttacagattatatattcatcaaacagaaacataaaaaactatgaagaggaaattcttaggaaaaagataatggagattgggatatcacaaaagcaacttgacatcagttttccaaagtgtgaaaactcatctgattgttctcttcagaagcatgaaattccagaggatatcagtgacagagatgatgatttcatttccaatgataattatgacttggagcctgcatctgaattaggagaagatttattgaagctttatgtgaaaccttgttgcccagatattgatatttttgttgatggaaaacgttttaaagctcacagggccattttgagtgccagatctagttattttgctgcaatgctgagtggctgttgggctgaaagctcccaagagtacgttactcttcaaggtataagccatgtagaactgaatgttatgatgcattttatatatggaggaactctggacattccagacaaaactaatgttgggtatgtattcctttttaataatttaaaatataaaagagttaggttctgctttgttgagctgtgttgcaaagtgttaatgaagtagaaactttgctttttatagtctattatactatatcttcagtaggttttgagaacatctaaaaacaataagcaaatcatcttatttagaagaaaaggtgacttatcaactcacagtaataagattgagaacagtctttattagacttaaatttagaagaagctataaattatggtttatagatcaataaattgattaaacttttatcaaactttaaaaattactactttttaaattttaggatatcttttctaaacagcaaaagaaaagaaaaaacatagttaagaatataggggctgggtgcggtggctctcgcctgtaatcccagcactttgtgaggctgaggcggacggatcacaagatcaagagatcgagaccatcctggctaacatggtgaaacctcgtctctactaaaaatacaaaaaaaaaaaaaa

SEQ ID NO: 112436 - DNA, 8486 bp, Homo sapiens
  Payload ID: 2005
  Gene Symbol: BTBD9
  Gene Name: BTB (POZ) domain containing 9
  Uniprot ID: Q96Q07
  ENST ID: ENST00000314100
  CDS Start-End: 318-1952
agataaggaattgtataggaggaaacttcatagtaaacattgaacctctgtgcttgtctccttgttgaagttgggggttcatgtttattgttccaagggagcctcatcaaaaccacttttaaagcattgagaatccaaataaataccatggatcatacaggattggggataagtcttgaggtctccccgagaaggagaagttctttaatttggtaattttagggtaatggttggatgctctctggattaatggaaaccttcaggggtacttttaggcagagtataacccagtgaagagagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataaaggaggcagcgggcctggtgtgacttggtgggctcgggcaacggcaggaaacggtctcctccctgagcaggggtctctgttgactgcccccacctctgcccctttccagggaggagccgacctagctgcaaaagcagacaccgaacaggttttctcccaaggacagaaaggggctgctttgttcttctcaatttatccaaatcaggcaggtctcaagggggagaaaatgggtcttcaatcttcatcaagtccaccattaacaccctacctctctaatctagcccaggcgcagggaacaggaggaagtcatagacaggcctgtgttggaatacaaaaatggcacgcaaacactcaggcggaggagaaagccattgggcctttgctacctggaggcaccctttaggaatgggcctccatagagtgttcattctgctggaatacattgccctggcaactaaatgattttttatttgttttagttattctccactcagtgaatcataggtgttccggatctatttgaaatgctcaaacagcaaatcactagttttaatcccttttgatgctataattttccttccttggttttgaacggttcagcttgcggggacagagacccatcgtgcatgtctcctaaatgagacacggatgcagctcatcctggcacttgggccacagaggaagtgccacaaatgcacacaagcaaatcaacctgtggacactggagttaatagtcactcgtgtggctgagttactcacctgtcattcctgacatggatccagcctttaagcttgggaggctgacaaggaaatagttactatgcccgctgctaattcactgttccgaagtccatgtagataaacatataccgagttctggcgtggccaaacctgccggggactgccgtggcttagctgcccctccagttgtgtttatcgaagcattggagaggcagccacctgcccatcagcgtcaggaacgcagaactgggactccgtgcttcccccacaccacagtactcaactggggactgaaaaatagcagttccaagaagcttttctcctaatcctcatcaaaaggacctcatttgacgatggtggcttgatgtggctccgtctcctacttagtgatttccattccagtgctgcctgccctgggtaactgcgcacaacattgcctgcccctccgctgtccccagagctccggcctctgtcgccatcagcatcagcctgggagtctccccaggacggcatggcacgtgagcagcactgcagtccttgggtcttcggcgccaacctgcaaccctgatcaaaggagggtgagggcgtgggagtttcctttcaggtgtgtcaaagacatatcagctgcgctctagaaagagccaacgggtcagccgcttcctcctagtttaacttgattttgagtgatttgtccatatggaaatagtagggtagcatcaaactgcgtgattaaattggaagactgtctttccgtgtgaacacaggatggcagacatcagagggctaccggggcagggtggacacgttcctgaggagaagccagggtctgcagctctccatcctccccggtagctccagctgcagggctgagctgcttcctatcccctcagctctgatctctgccacttccctgttgtgtgggagagtggaacactcctgggatgccaggcatttcataatgggaggaggctcctgtaaggaacggtgggcgcccgctcacagtggggggccctccagcatggttgctgactctgtcagcccccagccccgggttgccaattagccagagagctcctgcacacacagcacttccttccccagtgtgttttctacccagatggggacaaaggagccagacagtcatatcaagggcagagttcaaacattttgaaatgagccattcacatgcttctttttaaacatgggcatcacctgcccagaggcccttggcctgaagcagcatgctgctgaccttgggaagagagggtgggctggtgggggtgctggaggagctgcccggccctgcatctgcaaccctccagtcccctgcccacagagcacgcagagccctcctgtgctccgggaacgagatagcagcttggcagctcggcctcgcatctgaaaaggaatacgctgcaaagcctcggccctagacccacatctgcagctccctggcctgtggcggttctttccttcggggcatgcccttccagatctctgtccctcctgtcttctagcactttaaagatgccccttatcatcagataaagagaagtatggggacgatggggtggcactaacagtagatgtcattggtgaggactgatggcaaagtctcattccctcacagccgcgctgccagctcgcctccccctcgctttgctgggagcctgccctggactccaaaaggacacgggttcacctcctttcccaggctggaggggtactgcccttccctgaggggccttctgactggggcaggaactcttttcgtgtgtccagctgggcctggaggccaagtcaaggtgtgtcacaccacacaccagggcaaggacctcatctccagggaacagggacaagtgagtggctaccagaaagtccccgggcagcctggagttccccagagcctggctggtcctacagagcacttctcccctgggccaccaggaccaaagcgacctaaacacttgaagctaaaagcaagtgctgatgatgggatgggctggcacgtggctgggagggctcctgggcaccacagagccctcagcccagcagagagtggaggctcagtccgtggggagcgggggttgtgaaggagacatggccaagcccctggtcggggagataagctcccccatgcccaggccagccccaggggcaacaagccaacatggagagaggtggcaggtgaggctgacaggtgggtgcctgtggcctgggcccatgagggcaatggtcctcagtaaccaatggaaaggacacaagggcgccatggtcaccaccacccaggcaaagaaatgggaggtggccagcacccccacccttcacttttcattattattattattattattattattattttttttttttttttttttttttttttttttttttgagagtagaaaggcaacttcattggagcttttggggaaaaaagccttcaaagtcaccttctggcagctctggggagggtcatttggggtggactgagagtgtagggcaggtagggtgtgtgctgggcagcagctgtgtccatgcagccagcacccagcagggcagtctcacaggagccgttgtgagcactttggacttgaagcagctatgaaccaccccccgcccccaccgtctctccctctcacacacacacacacacacacacacacacacacacacacacacacacacccgttttaccattttctcagtgctttttctgctttcattcctttgattttagttagaagcacaagccatgatggatgtgggactcttctcaattgctctttaaattgtcactttttaaatcctattaaatgaagtgtcgattcctgacaaatacattaaaagtgttttattcctagaagagttgggaaaagaaattattttcagcaagagtaggatgtttgttaaactgattccttggcaaaaaagagaaaaaaagcttttgaattgtgcaaaaaattgcccagtattatgctgtcgccccagttgtcaaactgctgtgcagatggctccagcccagtcaacttcaccttctttttaatttagaagataacaaaattgtaatcacttatcctttccagagccaagggggaaaaggaaggtataatctacaataaaaagcgagcgttctgtgtactgaggccacttggtgataaagagatggagcgctcccctcacagacttcaattaagaacctccctttggacagggaagaaaggtgtcaaagaggaaaagaaaattaaatttgcttccttccaggagtttttcctcattagtgcttgcttgtcggtgttattattttaatcttaccttctatgtggtgaccagctcctccgagcgatgcccaggtcgggcacggcccgggcagggcaggtctgcagcgatgccgtggcagaggtgggcatactccatttgttttggcagctgcagccattgattctgcatatttttcctgacaacagccccggcaggagttcagttaggaatttaaagtgcagttcatggttctgtgccaccgtggcttttattattataatattaaattagaagttgtcctagtgcctggtgtttgctcagagtttccagaagagagggaagggcaaggtttaaatggcatgcaggacaactggaatgcccccatctctctcgctgacacggatccagtcatacctggggctggacgggatttggaggccctggtcatttgcagagtgaatggtgaagggcgcggaaaaggtttgcttggaggaaagaccggttgcagaggcgaggcggagggaggaggggcggaggcagcaggtctttgtttgtggtaggtctctggcttccatcagggaggaggaaagaggctgtgcccttcctggctcttggctgcaccactgaggacgctccgagggacagcgtgctcacccatcctttgcacagtgctggccccaagccccacggccttccagctaggattttctgctgggctcatgcagaggcaggggacaggtgcatggaagagccgccccacccgacacaccattgtttgaaaatcactgttctctttactcacttaaaaaagtgtacagggaacacctgttcctggcataatgctccaacctcgcggaaggggccaggtgcccttcatctggctctggctgcttccgacctgggcccacgtcatcgttcacgtcctctgtgaccaccactggtcacggtgctccctggcccagcctccaacccacccagcaccctggcatctcccaggccagtctgctgcacccagcgagcttccagtcagaagccaggctgaacggccctcctgccccatcagcttcgtgtcttcttttttttaaagaactgaaatagtccccaagaggcctcatggcctgaagactcacaatcatccacctgtaatttatgataaatgtctgggagcatttaccatttgcgtccgtgagtatttatagccctgaatgggcgggggggagggggggtggaggaggccctgcagccaggagctacacacctgtccccactagtgtcccctggttgacagagccccctcagcctccccaaggctgtcactgcggctgtgacagctgaggagtgccgcctttgaaagccagtggacagtcgctccactagggggagaggccctggccctggcgcagaggaggcgttgcgaggcgggacgggggctggaggggctgagcagccttcagggcagggactgggccctgggtcactggagacgttgatattagtccgtctgctgccaaattgctccccaccacatgagccccaggggtttatgtcccaggaaggcgagggtgcccatctgagcggaattgggaggggacggcaccagctcatctccctcagggcctttgcctcctggtgctgccctggtggctgctcctgcaccacagcccctgatggctgctgctagtcctgagttgctgggtttacccccagcccacacttcccacctgggcctgagggtgcggccagtgccctagtcctagccactacaggagtcattctgagacctgctggaggccatggggtcttcccaggcccctcaatcagctgcttccagggtcagcagggcagggtgctgccagtaaggtcctcagggagcacagcccggccgcccaggctgggggatactggggcagagcttccaggtctgtggggcctgatctctccccaaggctctccaggccttggtgcgccctccacagtgaccttcagagaggctgcaccccctcagaagaacagtgagaaatctctccatcacacgctccctggtccttatgtccctgaggccacccttccccaccccccagtgcctggagaagcgtgagactctggaggggcgccaggaggccaggggtcctcagggctaggcctggagctcggcccaagagctgcttttgcgaagcctgtcttgaatccggattcaccagagaacaagagcctcccagcctttggcgtttctgggcctgtaaagatgtgtgtacctcccaggccactctgatgcaagggcagggaccatgccaggcctgggttgggaatggctctgtgactccagaagctccgtctaaaactccaaagatgcccaaaaggctgtgctgctatgtggaatgtgtattatttgtgagcacgatgcggcttcttcctcattttgcagagcaacctaagcgggcagatgtacaaaccgtgtgttcgaaacccctgagtccatgtgtgtgaaaatgcaggttttctcttagaaataaagtggtgacttgtgctgta

SEQ ID NO: 112437 - DNA, 1968 bp, Homo sapiens
  Payload ID: 2005
  Gene Symbol: BTBD9
  Gene Name: BTB (POZ) domain containing 9
  ENST ID: ENST00000328403
  CDS Start-End: 239-1195
catgtttattgttccaagggagcctcatcaaaaccacttttaaagcattgagaatccaaataaataccatggatcatacaggattggggataagtcttgaggtctccccgagaaggagaagttctttaatttggtaattttagggtaatggttggatgctctctggattaatggaaaccttcaggggtacttttaggcagagtataacccagtgaagagagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcagtttatgagagatctatgatacaggagaagagggatctaactgacagtgacagtgcaaagtcctcaaaaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataaaggaggcagcgggcctggtgtgactt

SEQ ID NO: 112438 - DNA, 1155 bp, Homo sapiens
  Payload ID: 2005
  Gene Symbol: BTBD9
  Gene Name: BTB (POZ) domain containing 9
  ENST ID: ENST00000403056
  CDS Start-End: 1-1155
atgagtaacagccaccctcttcgcccctttactgcagtgggggaaattgatcatgtgcacattttgtctgaacatattggtgccttgttgattggggaagaatatggcgacgtcacattcgtggtggaaaagaaacgttttcctgcccacagggtaattttagcagccaggtgccaatattttcgagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcagg

SEQ ID NO: 112439 - DNA, 1062 bp, Homo sapiens
  Payload ID: 2005
  Gene Symbol: BTBD9
  Gene Name: BTB (POZ) domain containing 9
  ENST ID: ENST00000408958
  CDS Start-End: 1-1062
atgtgcagagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcagtagagatggggccttgccatgttgcccaggctggtcttcaactcctggactcaagcgatctgactgcttcagcctcacaaagtgc

SEQ ID NO: 112440 - DNA, 2034 bp, Homo sapiens
  Payload ID: 2005
  Gene Symbol: BTBD9
  Gene Name: BTB (POZ) domain containing 9
  Uniprot ID: Q96Q07
  ENST ID: ENST00000419706
  CDS Start-End: 260-2008
catgtttattgttccaagggagcctcatcaaaaccacttttaaagcattgagaatccaaataaataccatggatcatacaggattggggataagtcttgaggtctccccgagaaggagaagttctttaatttggtaattttagggtaatggttggatgctctctggattaatggaaaccttcaggggtacttttaggcagagtataacccagtgaagagcaaatcctatttgagggtttcttcatgtgtttcttccctgatgtgcagagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcagtggagatggagtctcactatggtgcccactctggtctcgaactcctgagctcaagcaatcctccctccttggccttccaaagtgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataaaggaggcagcgggcctggtgtgactt

SEQ ID NO: 112441 - DNA, 861 bp, Homo sapiens
  Payload ID: 2005
  Gene Symbol: BTBD9
  Gene Name: BTB (POZ) domain containing 9
  ENST ID: ENST00000497373
  CDS Start-End: 517-861
ggagccaggtgccggcagggcagccacaccctggggccccctgttctggaggggcagagggtcgggccgatgcgaaaaagccgcggaagctgccttaggcgactttctgggcctgcatcgccggacccagcagcccgctgtcgatcggttgctaagtgacgccagcgcgcagtggcgcgtgcgcggccacggcggagtgcgtgaaagcggacgcgcgccgcagcagccggggcggcggcgaggacggcggccacggaagcggccaagggggcggtggcgcagagaggggtgcggagcgggcggaagaggcgtctgtgtcgcagcttggtctcagaggagcatcgctgggtgggggaaattgatcatgtgcacattttgtctgaacatattggtgccttgttgattggggaagaatatggcgacgtcacattcgtggtggaaaagaaacgttttcctgcccacagggtaattttagcagccaggtgccaatattttcgagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaag

SEQ ID NO: 112442 - DNA, 8525 bp, Homo sapiens
  Payload ID: 2005
  Gene Symbol: BTBD9
  Gene Name: BTB (POZ) domain containing 9
  Uniprot ID: Q96Q07
  ENST ID: ENST00000481247
  CDS Start-End: 153-1991
agccggggcggcggcgaggacggcggccacggaagcggccaagggggcggtggcgcagagaggggtgcggagcgggcggaagaggcgtctgtgtcgcagcttggtctcagaggagcatcgctgggaacaacgactatcgtctattccacaagatgagtaacagccaccctcttcgcccctttactgcagtgggggaaattgatcatgtgcacattttgtctgaacatattggtgccttgttgattggggaagaatatggcgacgtcacattcgtggtggaaaagaaacgttttcctgcccacagggtaattttagcagccaggtgccaatattttcgagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataaaggaggcagcgggcctggtgtgacttggtgggctcgggcaacggcaggaaacggtctcctccctgagcaggggtctctgttgactgcccccacctctgcccctttccagggaggagccgacctagctgcaaaagcagacaccgaacaggttttctcccaaggacagaaaggggctgctttgttcttctcaatttatccaaatcaggcaggtctcaagggggagaaaatgggtcttcaatcttcatcaagtccaccattaacaccctacctctctaatctagcccaggcgcagggaacaggaggaagtcatagacaggcctgtgttggaatacaaaaatggcacgcaaacactcaggcggaggagaaagccattgggcctttgctacctggaggcaccctttaggaatgggcctccatagagtgttcattctgctggaatacattgccctggcaactaaatgattttttatttgttttagttattctccactcagtgaatcataggtgttccggatctatttgaaatgctcaaacagcaaatcactagttttaatcccttttgatgctataattttccttccttggttttgaacggttcagcttgcggggacagagacccatcgtgcatgtctcctaaatgagacacggatgcagctcatcctggcacttgggccacagaggaagtgccacaaatgcacacaagcaaatcaacctgtggacactggagttaatagtcactcgtgtggctgagttactcacctgtcattcctgacatggatccagcctttaagcttgggaggctgacaaggaaatagttactatgcccgctgctaattcactgttccgaagtccatgtagataaacatataccgagttctggcgtggccaaacctgccggggactgccgtggcttagctgcccctccagttgtgtttatcgaagcattggagaggcagccacctgcccatcagcgtcaggaacgcagaactgggactccgtgcttcccccacaccacagtactcaactggggactgaaaaatagcagttccaagaagcttttctcctaatcctcatcaaaaggacctcatttgacgatggtggcttgatgtggctccgtctcctacttagtgatttccattccagtgctgcctgccctgggtaactgcgcacaacattgcctgcccctccgctgtccccagagctccggcctctgtcgccatcagcatcagcctgggagtctccccaggacggcatggcacgtgagcagcactgcagtccttgggtcttcggcgccaacctgcaaccctgatcaaaggagggtgagggcgtgggagtttcctttcaggtgtgtcaaagacatatcagctgcgctctagaaagagccaacgggtcagccgcttcctcctagtttaacttgattttgagtgatttgtccatatggaaatagtagggtagcatcaaactgcgtgattaaattggaagactgtctttccgtgtgaacacaggatggcagacatcagagggctaccggggcagggtggacacgttcctgaggagaagccagggtctgcagctctccatcctccccggtagctccagctgcagggctgagctgcttcctatcccctcagctctgatctctgccacttccctgttgtgtgggagagtggaacactcctgggatgccaggcatttcataatgggaggaggctcctgtaaggaacggtgggcgcccgctcacagtggggggccctccagcatggttgctgactctgtcagcccccagccccgggttgccaattagccagagagctcctgcacacacagcacttccttccccagtgtgttttctacccagatggggacaaaggagccagacagtcatatcaagggcagagttcaaacattttgaaatgagccattcacatgcttctttttaaacatgggcatcacctgcccagaggcccttggcctgaagcagcatgctgctgaccttgggaagagagggtgggctggtgggggtgctggaggagctgcccggccctgcatctgcaaccctccagtcccctgcccacagagcacgcagagccctcctgtgctccgggaacgagatagcagcttggcagctcggcctcgcatctgaaaaggaatacgctgcaaagcctcggccctagacccacatctgcagctccctggcctgtggcggttctttccttcggggcatgcccttccagatctctgtccctcctgtcttctagcactttaaagatgccccttatcatcagataaagagaagtatggggacgatggggtggcactaacagtagatgtcattggtgaggactgatggcaaagtctcattccctcacagccgcgctgccagctcgcctccccctcgctttgctgggagcctgccctggactccaaaaggacacgggttcacctcctttcccaggctggaggggtactgcccttccctgaggggccttctgactggggcaggaactcttttcgtgtgtccagctgggcctggaggccaagtcaaggtgtgtcacaccacacaccagggcaaggacctcatctccagggaacagggacaagtgagtggctaccagaaagtccccgggcagcctggagttccccagagcctggctggtcctacagagcacttctcccctgggccaccaggaccaaagcgacctaaacacttgaagctaaaagcaagtgctgatgatgggatgggctggcacgtggctgggagggctcctgggcaccacagagccctcagcccagcagagagtggaggctcagtccgtggggagcgggggttgtgaaggagacatggccaagcccctggtcggggagataagctcccccatgcccaggccagccccaggggcaacaagccaacatggagagaggtggcaggtgaggctgacaggtgggtgcctgtggcctgggcccatgagggcaatggtcctcagtaaccaatggaaaggacacaagggcgccatggtcaccaccacccaggcaaagaaatgggaggtggccagcacccccacccttcacttttcattattattattattattattattattattttttttttttttttttttttttttttttttttttgagagtagaaaggcaacttcattggagcttttggggaaaaaagccttcaaagtcaccttctggcagctctggggagggtcatttggggtggactgagagtgtagggcaggtagggtgtgtgctgggcagcagctgtgtccatgcagccagcacccagcagggcagtctcacaggagccgttgtgagcactttggacttgaagcagctatgaaccaccccccgcccccaccgtctctccctctcacacacacacacacacacacacacacacacacacacacacacacacacccgttttaccattttctcagtgctttttctgctttcattcctttgattttagttagaagcacaagccatgatggatgtgggactcttctcaattgctctttaaattgtcactttttaaatcctattaaatgaagtgtcgattcctgacaaatacattaaaagtgttttattcctagaagagttgggaaaagaaattattttcagcaagagtaggatgtttgttaaactgattccttggcaaaaaagagaaaaaaagcttttgaattgtgcaaaaaattgcccagtattatgctgtcgccccagttgtcaaactgctgtgcagatggctccagcccagtcaacttcaccttctttttaatttagaagataacaaaattgtaatcacttatcctttccagagccaagggggaaaaggaaggtataatctacaataaaaagcgagcgttctgtgtactgaggccacttggtgataaagagatggagcgctcccctcacagacttcaattaagaacctccctttggacagggaagaaaggtgtcaaagaggaaaagaaaattaaatttgcttccttccaggagtttttcctcattagtgcttgcttgtcggtgttattattttaatcttaccttctatgtggtgaccagctcctccgagcgatgcccaggtcgggcacggcccgggcagggcaggtctgcagcgatgccgtggcagaggtgggcatactccatttgttttggcagctgcagccattgattctgcatatttttcctgacaacagccccggcaggagttcagttaggaatttaaagtgcagttcatggttctgtgccaccgtggcttttattattataatattaaattagaagttgtcctagtgcctggtgtttgctcagagtttccagaagagagggaagggcaaggtttaaatggcatgcaggacaactggaatgcccccatctctctcgctgacacggatccagtcatacctggggctggacgggatttggaggccctggtcatttgcagagtgaatggtgaagggcgcggaaaaggtttgcttggaggaaagaccggttgcagaggcgaggcggagggaggaggggcggaggcagcaggtctttgtttgtggtaggtctctggcttccatcagggaggaggaaagaggctgtgcccttcctggctcttggctgcaccactgaggacgctccgagggacagcgtgctcacccatcctttgcacagtgctggccccaagccccacggccttccagctaggattttctgctgggctcatgcagaggcaggggacaggtgcatggaagagccgccccacccgacacaccattgtttgaaaatcactgttctctttactcacttaaaaaagtgtacagggaacacctgttcctggcataatgctccaacctcgcggaaggggccaggtgcccttcatctggctctggctgcttccgacctgggcccacgtcatcgttcacgtcctctgtgaccaccactggtcacggtgctccctggcccagcctccaacccacccagcaccctggcatctcccaggccagtctgctgcacccagcgagcttccagtcagaagccaggctgaacggccctcctgccccatcagcttcgtgtcttcttttttttaaagaactgaaatagtccccaagaggcctcatggcctgaagactcacaatcatccacctgtaatttatgataaatgtctgggagcatttaccatttgcgtccgtgagtatttatagccctgaatgggcgggggggagggggggtggaggaggccctgcagccaggagctacacacctgtccccactagtgtcccctggttgacagagccccctcagcctccccaaggctgtcactgcggctgtgacagctgaggagtgccgcctttgaaagccagtggacagtcgctccactagggggagaggccctggccctggcgcagaggaggcgttgcgaggcgggacgggggctggaggggctgagcagccttcagggcagggactgggccctgggtcactggagacgttgatattagtccgtctgctgccaaattgctccccaccacatgagccccaggggtttatgtcccaggaaggcgagggtgcccatctgagcggaattgggaggggacggcaccagctcatctccctcagggcctttgcctcctggtgctgccctggtggctgctcctgcaccacagcccctgatggctgctgctagtcctgagttgctgggtttacccccagcccacacttcccacctgggcctgagggtgcggccagtgccctagtcctagccactacaggagtcattctgagacctgctggaggccatggggtcttcccaggcccctcaatcagctgcttccagggtcagcagggcagggtgctgccagtaaggtcctcagggagcacagcccggccgcccaggctgggggatactggggcagagcttccaggtctgtggggcctgatctctccccaaggctctccaggccttggtgcgccctccacagtgaccttcagagaggctgcaccccctcagaagaacagtgagaaatctctccatcacacgctccctggtccttatgtccctgaggccacccttccccaccccccagtgcctggagaagcgtgagactctggaggggcgccaggaggccaggggtcctcagggctaggcctggagctcggcccaagagctgcttttgcgaagcctgtcttgaatccggattcaccagagaacaagagcctcccagcctttggcgtttctgggcctgtaaagatgtgtgtacctcccaggccactctgatgcaagggcagggaccatgccaggcctgggttgggaatggctctgtgactccagaagctccgtctaaaactccaaagatgcccaaaaggctgtgctgctatgtggaatgtgtattatttgtgagcacgatgcggcttcttcctcattttgcagagcaacctaagcgggcagatgtacaaaccgtgtgttcgaaacccctgagtccatgtgtgtgaaaatgcaggttttctcttagaaataaagtggtgacttgtgctgta

SEQ ID NO: 112443 - DNA, 573 bp, Homo sapiens
  Payload ID: 2005
  Gene Symbol: BTBD9
  Gene Name: BTB (POZ) domain containing 9
  ENST ID: ENST00000498633
  CDS Start-End: 297-573
agagaggggtgcggagcgggcggaagaggcgtctgtgtcgcagcttggtctcagaggagcatcgctgggctcgtctcaatttggccctgctgtatttcaagtgctcggtagccacatgtggcaagtggccatcactgtggccattgcagctccaaagggacaggagagttgatggaaattagacactgcattctacagcctcatgagcccaagagagcaaaccttggtttgctgaaaatcagcagataaggcaattgaaagggaagaagaacaacgactatcgtctattccacaagatgagtaacagccaccctcttcgcccctttactgcagtgggggaaattgatcatgtgcacattttgtctgaacatattggtgccttgttgattggggaagaatatggcgacgtcacattcgtggtggaaaagaaacgttttcctgcccacagggtaattttagcagccaggtgccaatattttcgagcattattatatggtggaatgcgagagtctcagcctgaagcagaaattcctctccaagacaccactgcagaagcattcacaatgctactca

SEQ ID NO: 112444 - DNA, 5669 bp, Homo sapiens
  Payload ID: 2006
  Gene Symbol: BACH1
  Gene Name: BTB and CNC homology 1, basic leucine zipper transcription factor 1
  Uniprot ID: O14867
  ENST ID: ENST00000286800
  CDS Start-End: 144-2354
gagtgagtcacctgaccgctgccctcgccgcccgccgggcgctctcgcttcagtcagtcgggccgcgccgcgcctcagctctggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgcaaagtgaaaaggagagcttgttgaaggaaagagatcacattttgtcaactctgggtgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgttcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaa

SEQ ID NO: 112445 - DNA, 5769 bp, Homo sapiens
  Payload ID: 2006
  Gene Symbol: BACH1
  Gene Name: BTB and CNC homology 1, basic leucine zipper transcription factor 1
  Uniprot ID: O14867
  ENST ID: ENST00000399921
  CDS Start-End: 244-2454
gtctactcagcccggtggctgtcgcgcgtggaatcgcgtaagaaaagccgagtttgtggctggggagagaaggccaccgtgctgagctggatttagcgaagactggttttggggaccggagagcccaggactccctttgttggagttttgcccacgcgttgtaattaagcctcgcacaatatggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgcaaagtgaaaaggagagcttgttgaaggaaagagatcacattttgtcaactctgggtgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgttcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaa

SEQ ID NO: 112446 - DNA, 692 bp, Homo sapiens
  Payload ID: 2006
  Gene Symbol: BACH1
  Gene Name: BTB and CNC homology 1, basic leucine zipper transcription factor 1
  ENST ID: ENST00000435072
  CDS Start-End: 181-692
gcaaaagactgttgaagtagagagcattttgcccagctcactcggattctttgctggcatgccttcagtttcagttgtcatccagagaagtcaaaggaaatgctgcttggggatgagcatgttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtgga

SEQ ID NO: 112447 - DNA, 777 bp, Homo sapiens
  Payload ID: 2006
  Gene Symbol: BACH1
  Gene Name: BTB and CNC homology 1, basic leucine zipper transcription factor 1
  ENST ID: ENST00000451655
  CDS Start-End: 104-777
gcctttggacatcttgaagaagcttagggaagaaaggctcccggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccc

SEQ ID NO: 112448 - DNA, 751 bp, Homo sapiens
  Payload ID: 2006
  Gene Symbol: BACH1
  Gene Name: BTB and CNC homology 1, basic leucine zipper transcription factor 1
  ENST ID: ENST00000447177
  CDS Start-End: 92-751
atacacaagaagtttcaggagtcagaggagggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttg

SEQ ID NO: 112449 - DNA, 850 bp, Homo sapiens
  Payload ID: 2006
  Gene Symbol: BACH1
  Gene Name: BTB and CNC homology 1, basic leucine zipper transcription factor 1
  ENST ID: ENST00000422809
  CDS Start-End: 1-655
tccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgaaccatggcctgtggtcacttaatcagcaaccctggttcgccaacatcccatgcaccatcgtggagactggctggatgccctgtgctctatcagggcatgtcagaccaacagaggggcaaatcagagtgaagaggaagccagaagatgggagagacatttttgaaggaacaagctgccaataatgtctgcaaaaagtgaattcttccaacaactacgtgagcttggaagaggaccttgaacctagaatgagactgcagcagccccagccaacacccttctcagcttcgtggaccctgagcagagaacacagcaaatttgtccagacttctcatctacagaaactgagataataaatgattgttgttttaacatcccta

SEQ ID NO: 112450 - DNA, 325 bp, Homo sapiens
  Payload ID: 2006
  Gene Symbol: BACH1
  Gene Name: BTB and CNC homology 1, basic leucine zipper transcription factor 1
  ENST ID: ENST00000548219
  CDS Start-End: 251-325
gaagaagctattcaaaaatgtccaggactctgttatttattcagcaagcttacaaagccatctttgattgactgattctttgacaatgactatctggatgacacaggaaggatgcaattctggccttggagagaaaacttgcaaggaaaggaacatgtttgaatttcagatgtgttcctcaatgaatcacgttgatgataattagaagcatgctttccactgaacttcccgacaacatttgttatgcagaatgtctctgagtgagaactcggtttttgcctatgaatcttctgtgcatagcaccaatgttttactcagccttaat

SEQ ID NO: 112451 - DNA, 315 bp, Homo sapiens
  Payload ID: 2006
  Gene Symbol: BACH1
  Gene Name: BTB and CNC homology 1, basic leucine zipper transcription factor 1
  ENST ID: ENST00000547141
  CDS Start-End: 241-315
tctttgacaatgactatctggatgacacaggaaggatgcaattctggccttggagagaaaacttgcaaggaaaggaacatgtttgaatttcagatgtgttcctcaatgaatcacacttgttacatttactgactctcatggtggtggagatggattttttcctagtgtgcctgtgtgtgggttgatgataattagaagcatgctttccactgaacttcccgacaacatttgttatgcagaatgtctctgagtgagaactcggtttttgcctatgaatcttctgtgcatagcaccaatgttttactcagccttaat

SEQ ID NO: 112452 - DNA, 217 bp, Homo sapiens
  Payload ID: 2006
  Gene Symbol: BACH1
  Gene Name: BTB and CNC homology 1, basic leucine zipper transcription factor 1
  ENST ID: ENST00000548467
  CDS Start-End: 143-217
ggcagtttcatgtcattgagtagaattgtgcggaatgcttttatggagtgaggcttctgcgttaaacttgtgctgattccaggttgatgataattagaagcatgctttccactgaacttcccgacaacatttgttatgcagaatgtctctgagtgagaactcggtttttgcctatgaatcttctgtgcatagcaccaatgttttactcagccttaat

SEQ ID NO: 112453 - DNA, 349 bp, Homo sapiens
  Payload ID: 2006
  Gene Symbol: BACH1
  Gene Name: BTB and CNC homology 1, basic leucine zipper transcription factor 1
  ENST ID: ENST00000550131
  CDS Start-End: 275-349
tctttgacaatgactatctggatgacacaggaaggatgcaattctggccttggagagaaaacttgcaaggaaaggaacatgtttgaatttcagatgtgttcctcaatgaatcaccacgtctccttcctgccatcttgtgaagaagtgccttgcttccctttcaccttctgccatgattgtaagtttcctgaggcctctccagccatcctgaactgttgatgataattagaagcatgctttccactgaacttcccgacaacatttgttatgcagaatgtctctgagtgagaactcggtttttgcctatgaatcttctgtgcatagcaccaatgttttactcagccttaat

SEQ ID NO: 112454 - DNA, 485 bp, Homo sapiens
  Payload ID: 2006
  Gene Symbol: BACH1
  Gene Name: BTB and CNC homology 1, basic leucine zipper transcription factor 1
  ENST ID: ENST00000546469
  CDS Start-End: 411-485
tctttgacaatgactatctggatgacacaggaaggatgcaattctggccttggagagaaaacttgcaaggaaaggaacatgtttgaatttcagatgtgttcctcaatgaatcacgatcttcagggaatgtttcaggtggaggaaggggctcttggtcaatgagcctgaagactgcatggcaacctttgccagcttttggcctgaaaactcaacttcttcatttgagattagcaaaagactgttgaagtagagagcattttgcccagctcactcggattctttgctggcatgccttcagtttcagttgtcatccagagaagtcaaaggaaatgctgcttggggatgagcatgttgatgataattagaagcatgctttccactgaacttcccgacaacatttgttatgcagaatgtctctgagtgagaactcggtttttgcctatgaatcttctgtgcatagcaccaatgttttactcagccttaat

SEQ ID NO: 112455 - DNA, 663 bp, Homo sapiens
  Payload ID: 2006
  Gene Symbol: BACH1
  Gene Name: BTB and CNC homology 1, basic leucine zipper transcription factor 1
  ENST ID: ENST00000468059
  CDS Start-End: 1-415
ttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgccaacatcccatgcaccatcgtggagactggctggatgccctgtgctctatcagggcatgtcagaccaacagaggggcaaatcagagtgaagaggaagccagaagatgggagagacatttttgaaggaacaagctgccaataatgtctgcaaaaagtgaattcttccaacaactacgtgagcttggaagaggaccttgaacctagaatgagactgcagcagccccagccaacacccttctcagcttcgtggaccctgagcagagaacacagcaaatttgtccagacttctcatctacagaaactgagataataaatgattgttgttttaacatcccta

SEQ ID NO: 112456 - DNA, 9113 bp, Homo sapiens
  Payload ID: 2007
  Gene Symbol: BACH2
  Gene Name: BTB and CNC homology 1, basic leucine zipper transcription factor 2
  Uniprot ID: Q9BYV9
  ENST ID: ENST00000257749
  CDS Start-End: 709-3234
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcgttcacatagctcccagttttaacatttcgccacctactgaagacatcatttgggaccaagctgatgagcccttgaagcacagcagataagagtgttgctgttgatcatctttgcctgggaagttgaatgataaagccagaagaaagcatgctttctgatcatttgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtaccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaatatatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtgttgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcgcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatgagttagtgtttcttccccaaactgaagactgtgttggaagtgcaatttctggtgagtcagtccacaatacaatgccctgtgtggagttggtattcatacaggaaatctgtgtgcacgaggcattgtgtgttgaaagtgtatgtttatagtactgcctgagccatctcatgaccccagcgtccaaaaccgatgctgtagaacagaacatatctgtacacaaatagtgtgtgcaaatagcatttgtacatagaaaagtctcattgtggcagattgagcataaattattcaactgacggtgcaaaaacattacttgcaaagaaaagtttatagtattttcctacactccaccctgggagatgatatttctatcaaatgaatatcagtgcattttaaatgtaatatgaaaacgatgctgccattttgtgaagaatacccacttggttgcagaggccaactttcatagctttgatttaatgttgtgacacggtgtatgcattttgctgtcaagcaatggataaacagctctgactttcattctcattccagtttattgacctcagataaaacactggcccttcttagaagcagaagtgtgcaccaagaccattcatttcaggtagactcacattcagtgccaagtgctcccatgggaataatcagacgcatatgttgcgaaagagtgaagggacttggacaaagaggggttttcctacagatggatgctcagtcttctaccaaaacatgtttggaggcagaactatgacctccccttaagtcctaacaatgtattttgtgtgtgcaaatcctgggatgcccgtttcacgctctgacataaagacatggcacctctagtgagtgatcaggaagattccatatgcatttgggagcttcaggtgcttgttagacacagtgagccattcaaggcaagcaccacctttgctagtgaggccaagagagcctgtgacaatttgacaatttgttccagaaccagtctgatgcaagtgcacctctaatatatgccttacaaactccagaggccatattcaaaacagggtcttctcagtgtatgcaaggggctgcagcccctcttctcttcctccccaggttgaacaatacggacagttttcacacatatctacctgtataaccctctgtacctctcataactggtcaacgactgtaacaggttacatcaggtgtttttctacatactttttacacagattctatgcgattaatgtaatttaattcaatgcatcattttattgtactagttcttaggcttgtccttatttttttctaagtgattgtggtttttctcgtggtttttattgtaaaaaatgaaaggctgttgatgcttattctctgtaactaagaatttttaccttttgggggaaaaaagcattgctatgaactaatgaattgaaacttcatttactcattgtaaatacactattgtgcaaaaaaagttttcactcaattgaattgctagtgttaactgaattttgtctagacaccatttctgttgatgaaataaagacatatcattatgcattgtaaactg

SEQ ID NO: 112457 - DNA, 3981 bp, Homo sapiens
  Payload ID: 2007
  Gene Symbol: BACH2
  Gene Name: BTB and CNC homology 1, basic leucine zipper transcription factor 2
  Uniprot ID: Q9BYV9
  ENST ID: ENST00000343122
  CDS Start-End: 533-3058
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtaccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaatatatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtata

SEQ ID NO: 112458 - DNA, 780 bp, Homo sapiens
  Payload ID: 2007
  Gene Symbol: BACH2
  Gene Name: BTB and CNC homology 1, basic leucine zipper transcription factor 2
  ENST ID: ENST00000406998
  CDS Start-End: 538-780
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggag

SEQ ID NO: 112459 - DNA, 868 bp, Homo sapiens
  Payload ID: 2007
  Gene Symbol: BACH2
  Gene Name: BTB and CNC homology 1, basic leucine zipper transcription factor 2
  ENST ID: ENST00000453877
  CDS Start-End: 626-868
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcgttcacatagctcccagttttaacatttcgccacctactgaagacatcatttgggaccaagctgatgagcccttgaagcacagcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggag

SEQ ID NO: 112460 - DNA, 9108 bp, Homo sapiens
  Payload ID: 2007
  Gene Symbol: BACH2
  Gene Name: BTB and CNC homology 1, basic leucine zipper transcription factor 2
  Uniprot ID: Q9BYV9
  ENST ID: ENST00000537989
  CDS Start-End: 704-3229
gtcaacaatgtagcgattgagagtgtgggcgttccggggagagcgcaagccgcgcggcgcggagcaaacagcgccgagccgccgccgcctcagcagcagcagcagcagcagcagcggcagcagcggccgtgcacgcccgggctgcggtcgcacagcgctaacgtgagcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtaccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaatatatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtgttgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcgcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatgagttagtgtttcttccccaaactgaagactgtgttggaagtgcaatttctggtgagtcagtccacaatacaatgccctgtgtggagttggtattcatacaggaaatctgtgtgcacgaggcattgtgtgttgaaagtgtatgtttatagtactgcctgagccatctcatgaccccagcgtccaaaaccgatgctgtagaacagaacatatctgtacacaaatagtgtgtgcaaatagcatttgtacatagaaaagtctcattgtggcagattgagcataaattattcaactgacggtgcaaaaacattacttgcaaagaaaagtttatagtattttcctacactccaccctgggagatgatatttctatcaaatgaatatcagtgcattttaaatgtaatatgaaaacgatgctgccattttgtgaagaatacccacttggttgcagaggccaactttcatagctttgatttaatgttgtgacacggtgtatgcattttgctgtcaagcaatggataaacagctctgactttcattctcattccagtttattgacctcagataaaacactggcccttcttagaagcagaagtgtgcaccaagaccattcatttcaggtagactcacattcagtgccaagtgctcccatgggaataatcagacgcatatgttgcgaaagagtgaagggacttggacaaagaggggttttcctacagatggatgctcagtcttctaccaaaacatgtttggaggcagaactatgacctccccttaagtcctaacaatgtattttgtgtgtgcaaatcctgggatgcccgtttcacgctctgacataaagacatggcacctctagtgagtgatcaggaagattccatatgcatttgggagcttcaggtgcttgttagacacagtgagccattcaaggcaagcaccacctttgctagtgaggccaagagagcctgtgacaatttgacaatttgttccagaaccagtctgatgcaagtgcacctctaatatatgccttacaaactccagaggccatattcaaaacagggtcttctcagtgtatgcaaggggctgcagcccctcttctcttcctccccaggttgaacaatacggacagttttcacacatatctacctgtataaccctctgtacctctcataactggtcaacgactgtaacaggttacatcaggtgtttttctacatactttttacacagattctatgcgattaatgtaatttaattcaatgcatcattttattgtactagttcttaggcttgtccttatttttttctaagtgattgtggtttttctcgtggtttttattgtaaaaaatgaaaggctgttgatgcttattctctgtaactaagaatttttaccttttgggggaaaaaagcattgctatgaactaatgaattgaaacttcatttactcattgtaaatacactattgtgcaaaaaaagttttcactcaattgaattgctagtgttaactgaattttgtctagacaccatttctgttgatgaaataaagacatatcattatgcattgtaaactg

SEQ ID NO: 112461 - DNA, 2712 bp, Homo sapiens
  Payload ID: 2008
  Gene Symbol: BTG2
  Gene Name: BTG family, member 2
  Uniprot ID: P78543
  ENST ID: ENST00000290551
  CDS Start-End: 72-548
cagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgaggggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaa

SEQ ID NO: 112462 - DNA, 1275 bp, Homo sapiens
  Payload ID: 2008
  Gene Symbol: BTG2
  Gene Name: BTG family, member 2
  Uniprot ID: P78543
  ENST ID: ENST00000475157
  CDS Start-End: 117-593
aaaaacgctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctt

SEQ ID NO: 112463 - DNA, 1456 bp, Homo sapiens
  Payload ID: 2009
  Gene Symbol: BTG3
  Gene Name: BTG family, member 3
  Uniprot ID: Q14201
  ENST ID: ENST00000348354
  CDS Start-End: 258-1016
tcttccgggccgcgagccccctgcgcgccgctttggggctgcgctcactcgtgtgcgcgctcgtccgcccgccagtcctctcaacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatga

SEQ ID NO: 112464 - DNA, 1485 bp, Homo sapiens
  Payload ID: 2009
  Gene Symbol: BTG3
  Gene Name: BTG family, member 3
  Uniprot ID: Q14201
  ENST ID: ENST00000339775
  CDS Start-End: 155-1045
cgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcgtagagatggggtttcaccatgttggccagactgctctcaaactcctgacctcgtgatccgcccgccttggcctcccaaagcgctggattacaggcgtgagccactgcgcccggcctcctcctttttgattatgtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatga

SEQ ID NO: 112465 - DNA, 511 bp, Homo sapiens
  Payload ID: 2009
  Gene Symbol: BTG3
  Gene Name: BTG family, member 3
  ENST ID: ENST00000457956
  CDS Start-End: 374-511
ttccgggccgcgagccccctgcgcgccgctttggggctgcgctcactcgtgtgcgcgctcgtccgcccgccagtcctctcaacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgccgtgagcagaggagccttgtggaacaaagtagaacttgaggagcagccgccgcggtgacgaggtcccaggatgacgtcaccgtgcgatatttaaaatgggagccttttgctctgagtggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactgg

SEQ ID NO: 112466 - DNA, 511 bp, Homo sapiens; identical to SEQ ID NO: 112465
  Payload ID: 2009
  Gene Symbol: BTG3
  Gene Name: BTG family, member 3
  ENST ID: ENST00000628349
  CDS Start-End: 374-511

SEQ ID NO: 112467 - DNA, 597 bp, Homo sapiens
  Payload ID: 2009
  Gene Symbol: BTG3
  Gene Name: BTG family, member 3
  ENST ID: ENST00000627237
  CDS Start-End: 155-597
cgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcgtagagatggggtttcaccatgttggccagactgctctcaaactcctgacctcgtgatccgcccgccttggcctcccaaagcgctggattacaggcgtgagccactgcgcccggcctcctcctttttgattat

SEQ ID NO: 112468 - DNA, 568 bp, Homo sapiens
  Payload ID: 2009
  Gene Symbol: BTG3
  Gene Name: BTG family, member 3
  ENST ID: ENST00000629582
  CDS Start-End: 258-568
tcttccgggccgcgagccccctgcgcgccgctttggggctgcgctcactcgtgtgcgcgctcgtccgcccgccagtcctctcaacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcg

SEQ ID NO: 112469 - DNA, 2368 bp, Homo sapiens
  Payload ID: 2010
  Gene Symbol: BANP
  Gene Name: BTG3 associated nuclear protein
  Uniprot ID: Q8N9N5
  ENST ID: ENST00000286122
  CDS Start-End: 153-1712
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaggacacctccacatcgcccaggtgccgcagggggagcaagtccagatcacgcaggacagcgagggcaacctccagatccatcacgtggggcaggacggtcagcttctagaggccacccgcatcccctgcctcctggccccatccgtcttcaaagccagcagtggccaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccac

SEQ ID NO: 112470 - DNA, 2164 bp, Homo sapiens
  Payload ID: 2010
  Gene Symbol: BANP
  Gene Name: BTG3 associated nuclear protein
  Uniprot ID: Q8N9N5
  ENST ID: ENST00000355022
  CDS Start-End: 98-1507
aacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccaca

SEQ ID NO: 112471 - DNA, 1648 bp, Homo sapiens
  Payload ID: 2010
  Gene Symbol: BANP
  Gene Name: BTG3 associated nuclear protein
  ENST ID: ENST00000355163
  CDS Start-End: 321-1073
gggcaggtcccacggaggggatgctgcggccaggctccgtggggtggggcaccctgcgacgggctgctcctcttcccagggccaccggtgagactctcagtgcacagagtgcggttctgtgtggaggtgtgggatgcatctcctggccctcccgtagtggggtgcaaccccaagtgaagaccccgtggctcatgtcaagtgccctcagggctggggctgcccacccgcctgcctgggccgtcttgacaccggagctgcctgcctggatgttggagcgcccagtggattgagtgggaagtgggcctgggtgcttacaggcgatggggtcaccagagcccacccaggggcctcgcctgtcccccattctcattccatactctgggaggcggtacaaggtcgggagggccagcggggctctctgccaccaggactcacttccgcccatcttggaactgggcctcactttcctgcgagcttctgctgggttctcagtgcccaccagcagctcctttgctctccctgagcccttgaggtcactctgccttgggaatggggagggtttgggtctcagcctcacgctcacggtcctggcttggattttaggcctcagtggcactctgggagcgcttgtgctcttcatggttgccactgggattttccaggaggctctgtggcatttgctgttgctctctttttctgtggaagctctgccttgcttttttttttttcccttttttctgctctgtaggtgcttgagggcggagttgcagatccagcagagactcgatggcactctctcactggatctgatgcgacttgagagcgatggggagacaggatgtgccgcagagtcctcggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgagacgggagccctttggatggggccggtgtcagcaaaggaggca

SEQ ID NO: 112472 - DNA, 2438 bp, Homo sapiens
  Payload ID: 2010
  Gene Symbol: BANP
  Gene Name: BTG3 associated nuclear protein
  Uniprot ID: Q8N9N5
  ENST ID: ENST00000393207
  CDS Start-End: 222-1781
ctttctcagcctccttagtagctgggattacaggcatgtgccaccataccctgctaattttcgtatttttagtagagatggggttttgccacattggccaggctgacaggtgatccacccgccttggccttccaaagtgctgggatgacagatgtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaggacacctccacatcgcccaggtgccgcagggggagcaagtccagatcacgcaggacagcgagggcaacctccagatccatcacgtggggcaggacggtcagcttctagaggccacccgcatcccctgcctcctggccccatccgtcttcaaagccagcagtggccaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccaca

SEQ ID NO: 112473 - DNA, 2283 bp, Homo sapiens
  Payload ID: 2010
  Gene Symbol: BANP
  Gene Name: BTG3 associated nuclear protein
  Uniprot ID: Q8N9N5
  ENST ID: ENST00000393208
  CDS Start-End: 151-1626
agagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcagcttctagaggccacccgcatcccctgcctcctggccccatccgtcttcaaagccagcagtggccaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccaca

SEQ ID NO: 112474 - DNA, 586 bp, Homo sapiens
  Payload ID: 2010
  Gene Symbol: BANP
  Gene Name: BTG3 associated nuclear protein
  ENST ID: ENST00000412691
  CDS Start-End: 233-586
ttctctcgcgaggacggacgccattatcgcatctccccgacaaacaccacgagaattccgcagcccacacggatgcagaaagtagatgacattccatccacactgtgtgagcaaattggagagattgccttgatagaggactgatgtttttcactgatgagatggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaa

SEQ ID NO: 112475 - DNA, 560 bp, Homo sapiens
  Payload ID: 2010
  Gene Symbol: BANP
  Gene Name: BTG3 associated nuclear protein
  ENST ID: ENST00000436970
  CDS Start-End: 192-560
agtattcttggggagaaagataacagggaagtgaggagggttcagctgtggaagtgctgggatggctgatccgagtgaccatggcctagacggggtttaaaccctggactgaagaaagtgccggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgtcgtc

SEQ ID NO: 112476 - DNA, 455 bp, Homo sapiens
  Payload ID: 2010
  Gene Symbol: BANP
  Gene Name: BTG3 associated nuclear protein
  ENST ID: ENST00000436274
  CDS Start-End: 171-455
catctgtaaagtgaggtaggccccttcaagacatgtaaggagtatctatggctgtggaatgcatctttttagactggccgctctgcatggatctgatcacgggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaag

SEQ ID NO: 112477 - DNA, 644 bp, Homo sapiens
  Payload ID: 2010
  Gene Symbol: BANP
  Gene Name: BTG3 associated nuclear protein
  ENST ID: ENST00000423252
  CDS Start-End: 561-644
atcactttttttttttttgagacagagtctcgctctgtcgccaggctggagtgcagtggcgcgatctcggctcactgcaacctctgactcgcgggctcaagcgattctcctgcctcagcctcccgagtagttgggattacaaggcgcccgccaccacgcccggcataattttgtatttttagtagagacagggtttcgccatgttggccaggctggtcgcgaaccctttacctcaggtgttccgcccgccttggcctcccacagggctgagattacaggcgtgatccaccgtgcccggccgccatcacttatttatattatgtgttacctataggacttatctaagaccataatcactgccgcgtgtgctaagtcccgcgcgcgtgcactcaggcccctctggatagacactggggacccctgaccacttatgtcagggaaaacgccaccaagcgctccggaacctcagggcaggacccgccgcagcagcaggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaat

SEQ ID NO: 112478 - DNA, 566 bp, Homo sapiens
  Payload ID: 2010
  Gene Symbol: BANP
  Gene Name: BTG3 associated nuclear protein
  ENST ID: ENST00000456902
  CDS Start-End: 210-566
atttccactggccccttaagagaggcaggagtttaacctggactctctggacccggggctgtttgtggaagggcctcggcatgtccttgggtttagtctggctgcacgtggtgggctccagaataccctgttttgaaccaggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtg

SEQ ID NO: 112479 - DNA, 736 bp, Homo sapiens
  Payload ID: 2010
  Gene Symbol: BANP
  Gene Name: BTG3 associated nuclear protein
  ENST ID: ENST00000439677
  CDS Start-End: 153-736
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacattgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctggg

SEQ ID NO: 112480 - DNA, 558 bp, Homo sapiens
  Payload ID: 2010
  Gene Symbol: BANP
  Gene Name: BTG3 associated nuclear protein
  ENST ID: ENST00000454563
  CDS Start-End: 389-558
agagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacagccttgtgtgatgaccggtttccagtgagagtagagcctttgactgaggtcctgagaacctttgactaaccacaggcacttgtaggcatggagttttaaaagtttcattaagtgagaattcatctgcaaaggcttaggtggagatggttgatgcgctccctgcctgtgaggagtcatgaggccgaaggcatagccgtgtgctgtactcaagggacacccgcacctcagcccctgagtagctgggactatccagttgttttggagaatcatgtagtgacagatgaagacgaacctgctttgaaacgccagcgactagaaat

SEQ ID NO: 112481 - DNA, 640 bp, Homo sapiens
  Payload ID: 2010
  Gene Symbol: BANP
  Gene Name: BTG3 associated nuclear protein
  ENST ID: ENST00000466197
  CDS Start-End: 100-486
caaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgccttccacaacaaagcggaccttagatatcccttgtgaccagaaagtgctaaggcttaaaaacgcatgattgaaaactgtggcgtcgtcccccagactacagtaatactcaacaatgatcggcagaacgccattgtagccaagatggaagaccccttgagcaacagggcaccggattcc

SEQ ID NO: 112482 - DNA, 1551 bp, Homo sapiens
  Payload ID: 2010
  Gene Symbol: BANP
  Gene Name: BTG3 associated nuclear protein
  Uniprot ID: Q8N9N5
  ENST ID: ENST00000479780
  CDS Start-End: 151-1551
agagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtga

SEQ ID NO: 112483 - DNA, 627 bp, Homo sapiens
  Payload ID: 2010
  Gene Symbol: BANP
  Gene Name: BTG3 associated nuclear protein
  ENST ID: ENST00000459966
  CDS Start-End: 150-272
gagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacagtagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggcc

SEQ ID NO: 112484 - DNA, 608 bp, Homo sapiens
  Payload ID: 2010
  Gene Symbol: BANP
  Gene Name: BTG3 associated nuclear protein
  ENST ID: ENST00000485772
  CDS Start-End: 104-226
ccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacagtagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgggcgctaccgttttggaatgataccaacacttacgtggttacgaacgttagatctgtcccataggaatgagttgggatggagtgactgaaaatgtcaagccagttctcatgcaagtgtgcc

SEQ ID NO: 112485 - DNA, 2372 bp, Homo sapiens
  Payload ID: 2010
  Gene Symbol: BANP
  Gene Name: BTG3 associated nuclear protein
  Uniprot ID: Q8N9N5
  ENST ID: ENST00000538234
  CDS Start-End: 192-1718
agtattcttggggagaaagataacagggaagtgaggagggttcagctgtggaagtgctgggatggctgatccgagtgaccatggcctagacggggtttaaaccctggactgaagaaagtgccggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgacc

SEQ ID NO: 112486 - DNA, 2144 bp, Homo sapiens
  Payload ID: 2010
  Gene Symbol: BANP
  Gene Name: BTG3 associated nuclear protein
  Uniprot ID: Q8N9N5
  ENST ID: ENST00000626016
  CDS Start-End: 106-1599
ccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacattgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcagcttctagaggccacccgcatcccctgcctcctggccccatccgtcttcaaagccagcagtggccaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgc

SEQ ID NO: 112487 - DNA, 3507 bp, Homo sapiens
  Payload ID: 2011
  Gene Symbol: BUB1
  Gene Name: BUB1 mitotic checkpoint serine/threonine kinase
  Uniprot ID: O43683
  ENST ID: ENST00000302759
  CDS Start-End: 120-3377
atgggcaggcgccctgaaacgttcggcgagccgactgcggctgcgcggggtattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgt

SEQ ID NO: 112488 - DNA, 3287 bp, Homo sapiens
  Payload ID: 2011
  Gene Symbol: BUB1
  Gene Name: BUB1 mitotic checkpoint serine/threonine kinase
  Uniprot ID: O43683
  ENST ID: ENST00000409311
  CDS Start-End: 69-3155
attcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattagatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaa

SEQ ID NO: 112489 - DNA, 540 bp, Homo sapiens
  Payload ID: 2011
  Gene Symbol: BUB1
  Gene Name: BUB1 mitotic checkpoint serine/threonine kinase
  ENST ID: ENST00000436916
  CDS Start-End: 373-540
tttctcctattatatgttattttgtttgttcttctgagtacttaatgtaacctgacattactttgcatgtttctttttgtttagcccttctagctctccccaaggggaattttgctttgcctggctgctttttttcagctgtagttgagtatatggaagtgggggatgcagagttctctgggagctctgtggctgatttctgagcactgttatcatctgctcttcctcagggactttgttactttgaagcaatgaaaacaaactgtgtctgggaactctactttgtggtactctgggctgcctcacacccgtttacaatccctctttgactcgttccagccgtgtctcagccatgctcctgggaagcaaaggatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgac

SEQ ID NO: 112490 - DNA, 551 bp, Homo sapiens
  Payload ID: 2011
  Gene Symbol: BUB1
  Gene Name: BUB1 mitotic checkpoint serine/threonine kinase
  ENST ID: ENST00000447014
  CDS Start-End: 113-551
gttcaggtttggccgctgccggccagcgtcctctggccatggacaccccggaaaatgtccttcactgtgtaatacttcatgtaccctaattgatctaagcagtcaacacaggatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaag

SEQ ID NO: 112491 - DNA, 566 bp, Homo sapiens
  Payload ID: 2011
  Gene Symbol: BUB1
  Gene Name: BUB1 mitotic checkpoint serine/threonine kinase
  ENST ID: ENST00000420328
  CDS Start-End: 165-566
agtttgcggttcaggtttggccgctgccggccagcgtcctctggccatggacaccccggaaaatgtccttcactgtgtaatacttcatgtaccctaattgatctaagcagtcaacacaggttgttgacaatctgtttcaaatagtggcacggtgaaaaatcttgatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttattt

SEQ ID NO: 112492 - DNA, 3576 bp, Homo sapiens
  Payload ID: 2011
  Gene Symbol: BUB1
  Gene Name: BUB1 mitotic checkpoint serine/threonine kinase
  Uniprot ID: O43683
  ENST ID: ENST00000535254
  CDS Start-End: 113-3310
ggcgccctgaaacgttcggcgagccgactgcggctgcgcggggtattcgaatcggcggcggcttctagtttgcggttcaggtttggccgctgccggccagcgtcctctggccatggacaccccggaaaatgtccttcaatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaacttagttgttataaatatttcaacaaaatatacaaccccataaggtccctatatagcaggctgattgggctgcttctgggatgcaagcatttgtgagaataattcagacatgagcattctctagaaatcacttt

SEQ ID NO: 112493 - DNA, 3725 bp, Homo sapiens
  Payload ID: 2012
  Gene Symbol: BUB1B
  Gene Name: BUB1 mitotic checkpoint serine/threonine kinase B
  Uniprot ID: O60566
  ENST ID: ENST00000287598
  CDS Start-End: 196-3348
gaccgcgcgggaccgttaaatttgaaacttggcggctaggggtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccgacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaaggctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacaggcctcgtggcaatacagcttcactgatagctgtacccgctgtgcttcccagtttcactccatatgtggaagagactgcacgacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagaccccttgcagttctcaaaacctcagaaagcatcacctcaaatgaagatgtgtctccagatgtttgtgatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgagcccaattattgaagacagtcgtgaagccacacactcctctggcttctctggttcttctgcctcggttgcaagcacctcctccatcaaatgtcttcaaattcctgagaaactagaacttactaatgagacttcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaatgaggattactgcattaaacgagaatacctaatatgtgaagattacaagttattctgggtggcgccaagaaactctgcagaattaacagtaataaaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggatcttctccaacacagtgaatatattacccatgaaataacagtgttgattatttataaccttttgacaatagtggagatgctacacaaagcagaaatagtccatggtgacttgagtccaaggtgtctgattctcagaaacagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtagacctgtttggtatagcagatttagcacatttactattgttcaaggaacacctacaggtcttctgggatgggtccttctggaaacttagccaaaatatttctgagctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgttaaatttgtgcttctaa

SEQ ID NO: 112494 - DNA, 3628 bp, Homo sapiens
  Payload ID: 2012
  Gene Symbol: BUB1B
  Gene Name: BUB1 mitotic checkpoint serine/threonine kinase B
  Uniprot ID: O60566
  ENST ID: ENST00000412359
  CDS Start-End: 155-3349
gtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtgggtctttttatttcacaaggacaatagaaacattaacaggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccgacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaaggctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacaggcctcgtggcaatacagcttcactgatagctgtacccgctgtgcttcccagtttcactccatatgtggaagagactgcacgacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagaccccttgcagttctcaaaacctcagaaagcatcacctcaaatgaagatgtgtctccagatgtttgtgatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgagcccaattattgaagacagtcgtgaagccacacactcctctggcttctctggttcttctgcctcggttgcaagcacctcctccatcaaatgtcttcaaattcctgagaaactagaacttactaatgagacttcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaatgaggattactgcattaaacgagaatacctaatatgtgaagattacaagttattctgggtggcgccaagaaactctgcagaattaacagtaataaaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggatcttctccaacacagtgaatatattacccatgaaataacagtgttgattatttataaccttttgacaatagtggagatgctacacaaagcagaaatagtccatggtgacttgagtccaaggtgtctgattctcagaaacagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtagacctgtttggtatagcagatttagcacatttactattgttcaaggaacacctacaggtcttctgggatgggtccttctggaaacttagccaaaatatttctgagctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttc

SEQ ID NO: 112495 - DNA, 786 bp, Homo sapiens
  Payload ID: 2012
  Gene Symbol: BUB1B
  Gene Name: BUB1 mitotic checkpoint serine/threonine kinase B
  ENST ID: ENST00000559733
  CDS Start-End: 1-199
acaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaagggacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagacccctt

SEQ ID NO: 112496 - DNA, 580 bp, Homo sapiens
  Payload ID: 2012
  Gene Symbol: BUB1B
  Gene Name: BUB1 mitotic checkpoint serine/threonine kinase B
  ENST ID: ENST00000558715
  CDS Start-End: 155-445
gtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgagacggagtctcgctctttcggccaggctggagtgcagtggcacgatcttggctcactggaagctctgcctcctgggttcacgccaatctcctgcctcagcctcctgagtagctgggactacagggcatttgaatatgaaattcgattttacactggaaatgaccctctggatgtttgggataggtatatcagctggacagagcagaactatcctcaaggtgggaaggagagtaatatgtcaacgtt

SEQ ID NO: 112497 - DNA, 1361 bp, Homo sapiens
  Payload ID: 2013
  Gene Symbol: BUB3
  Gene Name: BUB3 mitotic checkpoint protein
  Uniprot ID: O43684
  ENST ID: ENST00000368858
  CDS Start-End: 72-1052
gaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 112498 - DNA, 667 bp, Homo sapiens
  Payload ID: 2013
  Gene Symbol: BUB3
  Gene Name: BUB3 mitotic checkpoint protein
  ENST ID: ENST00000368859
  CDS Start-End: 85-522
gagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatga

SEQ ID NO: 112499 - DNA, 7828 bp, Homo sapiens
  Payload ID: 2013
  Gene Symbol: BUB3
  Gene Name: BUB3 mitotic checkpoint protein
  Uniprot ID: O43684
  ENST ID: ENST00000368865
  CDS Start-End: 210-1196
gggttgaccgatgctgggcagctgagcggaccaatcggccccctagactgagacgttggcgtttgaaatcagccaatggcaggtctacactggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaatgttggatgtttttgaatgttggtaattaatataatttacttaaaaaggcttgtgtaaggcaaaactcgtcatcacaggcatgttgggggatgacattttacctttaagtccactctccctcgtttaattgtctcctctgatgtgtgttggggattcagtcctgcataaagtgatttgttggagttcagccatttccctcatgcccccttgtgccctctcggtggatcagcagggcctttgagccaagtgtgcagcttcactcaggatgggcagagactatgtggcagcctctggggaccttttggctcagtgctttactagtgccagcgcagtagtgcttaggtagcttgtgcatccccgtgttgatgtagtcatagtccacacagagccaaataacagacccttctgtacttagccatcaaatactaaatcacagtgaagcccttgggaaggtaaataatgtaatagccagggactgatggtattagttctttagtgtgattatgtgcttctaaaagtccctaaccacttggttgaggacagaccataagtttaaaacattgtataagtgaaagaattaatatagtattgttataggtaaccaaattatagtaatgtggacttgtttttgaggtggtgagggagggcttattttgtggttccatctggatgtcctcttgtctctggaaatcaagtgtgcctccctgccatctctacataccccttaaccagctctccacaatttacttgtttatggttatagctaccttttccccaagttacccaggtgtagttaccttggccttctcattggtttccctcacccacattctttaagtgtctcttctgtttatcttttcttcctactgctaccatcccagggccttttgggtgaatgtggcagcctccaatttctgccttaagtcctccatctaatagagtagtgacttttgaaccttgtagttgtgacccaagtaagaaatacattttgaactacagttcagaacacagaggtcagtatattatacatgacagaaggatcctgaaatatgacttgcccttcttgcatgcgatgtatctggtgcatgtgtgcatttttttctttgctttttaagaaatcctggctatgtcaccttgaattgattttacaacaaatgcctgtcacctgtaatttgcaaaaactgcttgatcagattctaaaaaatttctaaaagatttttaaaaaatgtattctgatgtcatacttggaatcctccactgcttcctgttgctcatagtcacccttcagtgatttcataaggaggtgtgctgcttcccaagcttctagatcatcaggaaggggccgcggactgtaaggtgctctcagaagatgggactaacctttgttgggaatataaataagtggatgggatgggaagtgacagcaatatctggttctgagttctgttgtgtaaaaacttaaaggtatattagcaggttagcctttgttctgtgggagatccaggccttgttagaaggaccaaggccagaatgcccagtttagccttagcattcaaacccttcattgtttttcctccattatctgttaaactcctgctttgccaaaggtatcttctataccctaataacactagcttccttccctcagtggggactcaacgcacattagcctactgagagcttagatcactacaacgaatccttgtaaatttgtttaactcagttttccccaaattcatttaagccggttctactttttctggtcttgttcccacaatcattttaccttttaccactcccccagaaaacactggggttcttctcttacgctgagagccaggttactttcttcactatcactccgacgcttgtgttgattcccaaatctcagtctgcccagggtcattctctttctgaattgctctttcaggatttaatttgaatcctgcaaagtcctgttcaaggcccccttttccatgaagcccttcttccttgttgcagctcacaaataagtgtgccctttctcaaaacacgtatgaaacacctcctgcttgtatacctttagcagtagttcctcatattgcctggcatttaaacatttttgtatgcgtacatcttgctttcctacttaaagcaagagcaggaccacatctttttgtatgctctggcacatgactgttggaccactttgatattgctgaattatatagactccttttaaaataatttgaaatataattttggagtatagacatcttgtccagtgcactagacaggtgacctttggctttgttcattaagcatttagtgtcttagaagtgatatgtttactgcagaaaaatttggatagcatgcaaaaaatgaaacatactatcacaatcctatgatataacttaaaaatttctttatagcttcatggaggtatttgatgaaaattgtatatatttaaggtatataatgttttgatacatgtatacattgtgaaatgattaccacaaggaggttactaaacatctccatcaccttgttaaattgagttaaacaaatttacaagttgacaaattacatttacaaatttatgtaattttttacgctttttttttttctcctttttctggagaacggggtctcgctatactgcccaggcaggtctcgaactcctgggctcaagctatcctcccgcctcttgcctccctaagagctgggattataggcgtgagccaccccacccggcctatgtcatttttttatgtggtgagaataaataatctcagcaaatttcaagtatacaattcattattactaagatagccaccacactgtatgtcagggctccagaacttactcatctcataggaggcagctacttttaacattcttggtgtatatccatccttcaggattttctgtatatttctctaacagcaaaagtttttgttagctacatcatgtgaaatgcctgggtagacaaatttaaagatgttatttgggatggtgtgacttgcacaagccacacagcctgcatggtgtccactttgagggggatgcccatagctatacttagaagtcatcctctagagcaagcttgtccaatttgttgtccatgggccacatgctgcccaggatggctttgaaggtggcccaaaacaaattcataaacttttgtaaaacgtgagattttttgtgattttttttttttcgagacacagtctcgttctgtcgcccaggctggagtgcaagtggcgcgatctccgctcattgcaagctccgcctctcgggttcaagcaattctcctgcctcagccacccgagtagttgggattacaggcacccgccatcacgcccggctaatttttgtatttcttttagtagagaccgggtttcatcatgttggccaggttggtcttgaactcctgacttcaggtaatccgccctccttggtctcccaaagtgctgggatacaggcatgagccactgcacccagctgtgacttttttttttttaagctcatcagctattgtattagtgtattttatgtgtagctcaagacaattcttccagtgtggaccaggaaagccaaaagattggacacccctgccctagagcatctgacgcctggatacaaaagagcctgtggctatgactatcaggattctggccatgaggaattccatgacatggagggaaaatggcaacttcaaatttgcacccccaggtatcatgtgggcaggtgctccatgtggctggtgatagttgtgagtgagccttgcacgggctttccccctatcggctgttccagagcgagaggctgcaggtgtccacttacgtacctgtggctaagatgcgcctgagcaagtgagggccagttagtatacataatttttacaaaatttggatcatattacataaatatcttgcttcatgcacttaatatgaaattttgcccatgatttattttttaccttatttttaagggccacctagttagaatttgattatttgagcaactatttagtgcctgtgatgtgccagccactgctaggttctggggctcaaaacactgtgacagatgctgtgataccacaacgtggccacattttgttttcaagaccttggccaacctttggtcttcacagccactgccctggtagtaagggacttagttaagtttggtgactgcttgaagtctaagatcaccaaagtggctaatgcaggcactgtgacaatctgggcactaggaaaagcaatgtgggcagaaattccttgttcgagagccttctggttatactttaaaaagaagggagcctagcatcttgtcaaatctttgagcccactcactcagagggcctgtcactcatccagaattgaatctgctggtttaacaggtcaggcagtgtgatttgacagcgtgaatcttagagtccagcctttgaacctggcgctgaatcctgactttactgcttattcagggggccactagctaagttaatttgtgagcctgggcaacatggcgtgacccatctctacaaaagatacaaaaattaactggatgtggtggtgcatgcctgtagttcatagctactctggaggctgaggcgggaggataacctgagtgcgggaggttgaggttgcagtgagctgaagttgcaccactgcactccagcctaggtgacagagtgagaccttatcttaatctaaaaaataaaatttctgagccttattttcctcatctgtaaaatgaagagaatacctagctcatggagttaggaacaagtatgttaaatatttatcagagtgtgcctgacagtgagttgaaaatatctactctctttggatgaaaaatatttaacacttcactctcagatataattattagctgactttttagattcttttttcttttacatgatgtagttctcagatatatacgggatttctagttcttaaatgccagtattttttttctgttaaaatatttatgaactatttcaaacattcagaaaaactcaggatcatacccataaacccactgtttagattttaaaaagttcaatgtttttctgtattttatctcttcattttaaaataaagttttgcacatg

SEQ ID NO: 112500 - DNA, 895 bp, Homo sapiens
  Payload ID: 2013
  Gene Symbol: BUB3
  Gene Name: BUB3 mitotic checkpoint protein
  ENST ID: ENST00000407911
  CDS Start-End: 60-895
tgtcagtgcgcagccccagcccgcgggacccctggggactctgggcgcctgttctgcagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcat

SEQ ID NO: 112501 - DNA, 2196 bp, Homo sapiens
  Payload ID: 2014
  Gene Symbol: BUD13
  Gene Name: BUD13 homolog
  Uniprot ID: Q9BRD0
  ENST ID: ENST00000260210
  CDS Start-End: 25-1884
cgtctctctgcccccgccgctgccatggcggcagctccgccgctttccaaggccgagtatctgaagcgttacttgtccggggcagatgccggcgtcgaccggggatctgagtccggtcgcaagcgtcgcaaaaagcggccgaagcctggcggggccggcggcaagggaatgcggattgtggatgatgatgtgagctggacagctatctccacaaccaaactagaaaaggaggaagaggaagatgatggagatttgcctgtggtggcagagtttgtggatgagcggccagaagaggtaaagcagatggaggcctttcgttccagtgccaaatggaagcttctgggaggccacaacgaagacctaccctcaaacagacattttcgtcacgataccccggattcatctcctaggagggtccgtcatggtaccccagatccatctcctaggaaggaccgtcatgacaccccggatccatctcctaggagggcccgtcatgacaccccggatccttctcccctcagaggggctcgtcatgactcagacacatctcctcccaggaggatccgtcatgactcctcagacacttcacccccaaggagggcccgtcatgattctccagatccttctcccccaaggaggcctcagcataattcttcaggtgcatctcctaggagagtccgtcatgattcaccagatccctctcctcctaggcgagcccgtcatggttcctcagatatctcttcccccagaagggtccataacaactcccctgacacatctaggaggactcttggctcttcagacacacagcaactcagaagggcccgtcatgactcccctgatttggctcctaatgtcacttattccctgcccagaaccaaaagtggtaaagccccagaaagagcctctagcaagacttctccacattggaaggagtcaggagcctcccatttgtcattcccaaagaacagcaaatatgagtatgaccctgacatctctcctccacgaaaaaagcaagcaaaatcccattttggagacaagaagcagcttgattccaaaggtgactgccagaaagcaactgattcagacctttcttctccacggcataaacaaagtccagggcaccaggattctgattcagatctgtcacctccacggaatagacctagacaccggagctctgattctgacctctctccaccaaggaggagacagaggaccaaatcttctgattctgacctgtccccgcctcgaaggagtcagcctcctggaaagaaggctgcacacatgtattctggggctaaaactgggttggtgttaactgacatacagcgagaacagcaggagctcaaggaacaggatcaagaaaccatggcatttgaagctgaatttcaatatgctgaaaccgtatttcgagataagtctggtcgtaagaggaatttgaaactcgaacgtttagagcaaaggaggaaagcagaaaaggactcagagagagatgagctgtatgcccagtggggaaaagggcttgcccagagccggcaacagcaacaaaatgtggaggatgcaatgaaagagatgcaaaagcctctggcccgctatattgatgacgaagatctggataggatgctaagagaacaggaaagagagggggaccctatggccaacttcatcaagaagaataaggccaaggagaacaagaataaaaaagtgagacctcgctacagtggtccagcacctcctcccaacagatttaatatctggcctggatatcgctgggacggagtggacagatccaatggatttgaacagaagcgctttgccaggcttgccagcaagaaggcagtggaggaacttgcctacaaatggagtgttgaggatatgtaactttcctgaggctgtgggggtggctgggctgtggtagtgggcataggcagcgagatatccagtggtaacagttgtctgtgctaataattggagcccacacagaccagcaacttgttgaatgccagttttgaccacagaagaatattcgagacctgatgtttggactgaggtacctgtacttcttgggtgtgacagcaccggctgttgctggctttcagaggaagcattgatttctcattgaccagggtttgttcttggtagggtttttctttttcttttttaaataaacatgtatttatttttttaaaatta

SEQ ID NO: 112502 - DNA, 1793 bp, Homo sapiens
  Payload ID: 2014
  Gene Symbol: BUD13
  Gene Name: BUD13 homolog
  Uniprot ID: Q9BRD0
  ENST ID: ENST00000375445
  CDS Start-End: 24-1481
gtctctctgcccccgccgctgccatggcggcagctccgccgctttccaaggccgagtatctgaagcgttacttgtccggggcagatgccggcgtcgaccggggatctgagtccggtcgcaagcgtcgcaaaaagcggccgaagcctggcggggccggcggcaagggaatgcggattgtggatgatgatgtgagctggacagctatctccacaaccaaactagaaaaggaggaagaggaagatgatggagatttgcctgtggtggcagagtttgtggatgagcggccagaagaggtaaagcagatggaggcctttcgttccagtgccaaatggaagcttctgggaggccacaacgaagacctaccctcaaacagacattttcgtcacgataccccggattcatctcctaggagggtccgtcatggtaccccagatccatctcctaggaaggaccgtcatgacaccccggatccatctcctaggagggcccgtcatgacaccccggatccttctcccctcagaggggctcgtcatgactcagacacatctcctcccaggaggatccgtcatgactcctcagacacttcacccccaaggagggcccgtcatgattctccagatccttctcccccaaggaggcctcagcataattcttcaggtgactgccagaaagcaactgattcagacctttcttctccacggcataaacaaagtccagggcaccaggattctgattcagatctgtcacctccacggaatagacctagacaccggagctctgattctgacctctctccaccaaggaggagacagaggaccaaatcttctgattctgacctgtccccgcctcgaaggagtcagcctcctggaaagaaggctgcacacatgtattctggggctaaaactgggttggtgttaactgacatacagcgagaacagcaggagctcaaggaacaggatcaagaaaccatggcatttgaagctgaatttcaatatgctgaaaccgtatttcgagataagtctggtcgtaagaggaatttgaaactcgaacgtttagagcaaaggaggaaagcagaaaaggactcagagagagatgagctgtatgcccagtggggaaaagggcttgcccagagccggcaacagcaacaaaatgtggaggatgcaatgaaagagatgcaaaagcctctggcccgctatattgatgacgaagatctggataggatgctaagagaacaggaaagagagggggaccctatggccaacttcatcaagaagaataaggccaaggagaacaagaataaaaaagtgagacctcgctacagtggtccagcacctcctcccaacagatttaatatctggcctggatatcgctgggacggagtggacagatccaatggatttgaacagaagcgctttgccaggcttgccagcaagaaggcagtggaggaacttgcctacaaatggagtgttgaggatatgtaactttcctgaggctgtgggggtggctgggctgtggtagtgggcataggcagcgagatatccagtggtaacagttgtctgtgctaataattggagcccacacagaccagcaacttgttgaatgccagttttgaccacagaagaatattcgagacctgatgtttggactgaggtacctgtacttcttgggtgtgacagcaccggctgttgctggctttcagaggaagcattgatttctcattgaccagggtttgttcttggtagggtttttctttttcttttttaaataaacatgtatttatttttttaaaatta

SEQ ID NO: 112503 - DNA, 947 bp, Homo sapiens
  Payload ID: 2014
  Gene Symbol: BUD13
  Gene Name: BUD13 homolog
  ENST ID: ENST00000419189
  CDS Start-End: 1-355
atctaggaggactcttggctcttcagacacacagcaactcagaagggcccgtcatgactcccctgatttggctcctaatgtcacttattccctgcccagaaccaaaagtggtaaagccccagaaagagcctctagcaagacttctccacattggaaggagtcaggagcctcccatttgtcattcccaaagaacagcaaatatgagtatgaccctgacatctctcctccacgaaaaaagcaagcaaaatcccattttggagacaagaagcagcttgattccaaagagccggcaacagcaacaaaatgtggaggatgcaatgaaagagatgcaaaagcctctggcccgctatattgatgacgaagatctggataggatgctaagagaacaggaaagagagggggaccctatggccaacttcatcaagaagaataaggccaaggagaacaagaataaaaaagtgagacctcgctacagtggtccagcacctcctcccaacagatttaatatctggcctggatatcgctgggacggagtggacagatccaatggatttgaacagaagcgctttgccaggcttgccagcaagaaggcagtggaggaacttgcctacaaatggagtgttgaggatatgtaactttcctgaggctgtgggggtggctgggctgtggtagtgggcataggcagcgagatatccagtggtaacagttgtctgtgctaataattggagcccacacagaccagcaacttgttgaatgccagttttgaccacagaagaatattcgagacctgatgtttggactgaggtacctgtacttcttgggtgtgacagcaccggctgttgctggctttcagaggaagcattgatttctcattgaccagggtttgttcttggtagggtttttctttttcttttttaaataaacatgtatttatttttttaaaatta

SEQ ID NO: 112504 - DNA, 1035 bp, Homo sapiens
  Payload ID: 2015
  Gene Symbol: BUD31
  Gene Name: BUD31 homolog
  Uniprot ID: P41223
  ENST ID: ENST00000222969
  CDS Start-End: 434-868
cagctacccaagctccaggagcttccggtatgtgttttccctctgttctcgattaccttggcaacggctgaggcgggagaccggtggtctgcaccgtcctggagggagatatgagtggctggactctcagccagccactgggatgtgttcgggctttggaccttgaggccggagagagctcccgagaggaggcggcgccacgttcgttcttctgaggggacggtagatttgggggttttcctctaggattctcgcgccgtttcctctgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaa

SEQ ID NO: 112505 - DNA, 1139 bp, Homo sapiens
  Payload ID: 2015
  Gene Symbol: BUD31
  Gene Name: BUD31 homolog
  Uniprot ID: P41223
  ENST ID: ENST00000403633
  CDS Start-End: 530-964
gccgccgccgccgcttcagtggccgcagtggccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatctctcga

SEQ ID NO: 112506 - DNA, 519 bp, Homo sapiens
  Payload ID: 2015
  Gene Symbol: BUD31
  Gene Name: BUD31 homolog
  ENST ID: ENST00000456893
  CDS Start-End: 37-348
cccccagatctttgcagattatcctgtggaaggaaaatgcctaaagtcaaaagaagccggaaagcacccccagatggctgggagttgattgagccaacactggatgaattagatcaaaagatgagagaagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatcagctgtgatttgtaaaaataaaatctttaaatctc

SEQ ID NO: 112507 - DNA, 608 bp, Homo sapiens
  Payload ID: 2015
  Gene Symbol: BUD31
  Gene Name: BUD31 homolog
  ENST ID: ENST00000431419
  CDS Start-End: 125-472
agacagctgagcctgggaatcccaccaagacgcggagaccggtagtggccccaaatgccaggctgcactgatatttattggatacaagacaaaggggcaggataagcagtgtgaaccatctccaatgatagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgcagacaaaaacctgattgcaaaatggaaaaagcaaggatatgagaacttgtgctgcctgcggtgcattcagacacgggacaccaacttcgggacgaactgcatctgccgcgtgcccaaaagcaagctggaagtgggccgcatcatcgagtgcacacactgtggctgtcgtggctgctctggctgaggctggcgcgctccaccctggactctggacttcgcaggttcctgcctgtcacgccacccccttcctgggagcagcgagcagtgccccaggcccgagttggagcacggtctctatggggaaggcttcgctgtctatc

SEQ ID NO: 112508 - DNA, 889 bp, Homo sapiens
  Payload ID: 2015
  Gene Symbol: BUD31
  Gene Name: BUD31 homolog
  ENST ID: ENST00000427499
  CDS Start-End: 499-612
ccgcaaggacccggacctcagggaggcctccgcacgaagtcggaccgtcctgcgcgccgcctaagtccaggcttgcccgtctgctgccaggcaacaacgcccctagtctctccgttcgggaagacgcgtggccctgcctgccacccaccggaagtgagggcaaatggcaacagcggctctggaattctatacaggcattgctgaggacacctaagatgacgcaatctccgcgcgggtagggcggggctccgcaaggacctcatgccttagagatcgcctgaagagcggaagccttctgtcgagaagcagctacccaagctccaggagcttccgaagaaacaggaccagagagggaaggtgacctgaaagtcacagaataattttttagagctgaacaagaatccaagcctgcaactgcagagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaaggctgcagtgcagtggcgtgatctcggctcactgcaacctctgcctcccgtgttcaagtgattttcctgcctctcagcctctcgagtaatttggattacaggcatgcgccaccatgcccggctaatttttgtatttttagtagagatgggtttctccatgttggccaggctggtctcgaactcctggcctcaagtgatccacccacctcggcctcccaaagtgatgggattacagctgaaacagaaccgcatgagggaaagaggaaagtggaatctctgtggcccatcttcaggatcc

SEQ ID NO: 112509 - DNA, 1886 bp, Homo sapiens
  Payload ID: 2016
  Gene Symbol: BBOX1
  Gene Name: butyrobetaine (gamma), 2-oxoglutarate dioxygenase (gamma-butyrobetaine hydroxylase) 1
  Uniprot ID: O75936
  ENST ID: ENST00000263182
  CDS Start-End: 369-1532
aagaagtgaactgcttgttcacttgctgctgttgccactgctggtacagaaatagaaggtaagacagcacaaaaaaacaaagacaaaaaacctccaagctcccttcagtagttgctacaccttcagattgagacatccttcctcatttacaaacctcagctgtgtctgggggcagggccacagtgaaactgccaggagcaaaaaggcttccaagaaaaagtaccacatcagattggaaactggggacagatcattcctgggatgtgacgggcaccagaatgctccctctccaaaggatctaaggaccaaagctgacagtttctttacttgcaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgttgcatgcctgctctaatttcttttgcccatatatgagtatctccagaatgtctacaaatagtttttgtagcaaatgaaaatttcttcaaataagccttttgtttcaaataaaacttgtctcaaaacatgcttc

SEQ ID NO: 112510 - DNA, 1596 bp, Homo sapiens
  Payload ID: 2016
  Gene Symbol: BBOX1
  Gene Name: butyrobetaine (gamma), 2-oxoglutarate dioxygenase (gamma-butyrobetaine hydroxylase) 1
  Uniprot ID: O75936
  ENST ID: ENST00000525090
  CDS Start-End: 215-1378
acagtatgtgaaatactctcaccagaacaaaggtcccagcgtcaataagtcaaaccgcagactctgacagctgagtgaatagcagaggccagagtccacttgaagtgttcacactctcagaggccaagtttagatcttatctgcctgagattccttttaacactgatttgtcatagcaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctc

SEQ ID NO: 112511 - DNA, 1724 bp, Homo sapiens
  Payload ID: 2016
  Gene Symbol: BBOX1
  Gene Name: butyrobetaine (gamma), 2-oxoglutarate dioxygenase (gamma-butyrobetaine hydroxylase) 1
  Uniprot ID: O75936
  ENST ID: ENST00000528583
  CDS Start-End: 205-1368
tctgggggcagggccacagtgaaactgccaggagcaaaaaggcttccaagaaaaagtaccacatcagattggaaactggggacagatcattcctgggatgtgacgggcaccagaatgctccctctccaaaggatctaaggaccaaagctgacagtttctttacttgcaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgttgcatgcctgctctaatttcttttgcccatatatgagtatctccagaatgtctacaaatagtttttgtagcaaatgaaaatttcttcaaataagccttttgtttcaaataaaacttgtctcaaaacatgcttcta

SEQ ID NO: 112512 - DNA, 703 bp, Homo sapiens
  Payload ID: 2016
  Gene Symbol: BBOX1
  Gene Name: butyrobetaine (gamma), 2-oxoglutarate dioxygenase (gamma-butyrobetaine hydroxylase) 1
  ENST ID: ENST00000533566
  CDS Start-End: 498-703
gacaagtagataccacttcacctctgctagggtgagcgctggtagctcctccctgttaaatgcccatctcaatgcctctgccctaagtgagttgtgcaataaatgagctgtcactctgaacaggtgggaaagaagtgaactgcttgttcacttgctgctgttgccactgctggtacagaaatagaaggtaagacagcacaaaaaaacaaagacaaaaaacctccaagctcccttcagtagttgctacaccttcagattgagacatccttcctcatttacaaacctcagctgtgtctgggggcagggccacagtgaaactgccaggagcaaaaaggcttccaagaaaaagtaccacatcagattggaaactggggacagatcattcctgggatgtgacgggcaccagaatgctccctctccaaaggatctaaggaccaaagctgacagtttctttacttgcaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatt

SEQ ID NO: 112513 - DNA, 1725 bp, Homo sapiens
  Payload ID: 2016
  Gene Symbol: BBOX1
  Gene Name: butyrobetaine (gamma), 2-oxoglutarate dioxygenase (gamma-butyrobetaine hydroxylase) 1
  Uniprot ID: O75936
  ENST ID: ENST00000529202
  CDS Start-End: 340-1503
gcagagaaaggagggcatcaagcttaggggaccaatccctgtctttctaccagtccctgataactactcaagctccctttaaagaggctcatattggaatactctgttgacaagtagataccacttcacctctgctagggtgagcgctggtagctcctccctgttaaatgcccatctcaatgcctctgccctaagtgagttgtgcaataaatgagctgtcactctgaacaggtgggaaagaagtgaactgcttgttcacttgctgctgttgccactgctggtacagaaatagaaggtaagacaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgtt

SEQ ID NO: 112514 - DNA, 2895 bp, Homo sapiens
  Payload ID: 2017
  Gene Symbol: BTN1A1
  Gene Name: butyrophilin, subfamily 1, member A1
  Uniprot ID: Q13410
  ENST ID: ENST00000244513
  CDS Start-End: 67-1647
atctcctaggctgaagctcctgaggggactcacatcagttatcttgctgctccagaagggtgggagatggcagttttcccaagctccggtctccccagatgtctgctcaccctcattctcctccagctgcccaaactggattcagctccctttgacgtgattggacccccggagcccatcctggccgttgtgggtgaggacgccgagctgccctgtcgcctgtctccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctgctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctgcgaaaaatgtgtcctgctacatccagaatctccttcttggccaggagaagaaagtagaaatatccataccagcttcctccctcccaaggctgactccctggatagtggctgtggctgtcatcctgatggttctaggacttctcaccattgggtccatatttttcacttggagactatacaacgaaagacccagagagaggaggaatgaattcagctctaaagagagactcctggaagaactcaaatggaaaaaggctaccttgcatgcagttgatgtgactctggacccagacacagctcatccccacctctttctttatgaggattcaaaatctgttcgactggaagattcacgtcagaaactgcctgagaaaacagagagatttgactcctggccctgtgtgttgggccgtgagaccttcacctcaggaaggcattactgggaggtggaggtgggagacaggactgactgggcaatcggcgtgtgtagggagaatgtgatgaagaaaggatttgaccccatgactcctgagaatgggttctgggctgtagagttgtatggaaatgggtactgggccctcactcctctccggacccctctcccattggcagggcccccacgccgggttgggattttcctagactatgaatcaggagacatctccttctacaacatgaatgatggatctgatatctatactttctccaatgtcactttctctggccccctccggcccttcttttgcctatggtctagcggtaaaaagcccctgaccatctgcccaattgctgatgggcctgagagggtcacagtcattgctaatgcccaggacctttctaaggagatcccattgtcccccatgggggaggactctgcccctagggatgcagacactctccattctaagctaatccctacccaacccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaactcaaaggacagattagggatcgagattgggtcaggttagcatggggttgtggttgaaatatcttggtatccaggataagggtatgtggaaaaacaggctttaggcaagtggaaaattcaaaatgtgctgtgaaaggacaatctcaggctgaaatcccataaaggaacttggagggaatattatgatggagggaagtgaggtgaatccaggcacatgatgaacacctggctcatccatagagttttcacagcctatatcgcaaattttctaagccacgtcctataggacagaggagactggccccacttctatgggtctgagctgtggaaaagggagagcagagaggaactgagatgagcagggatgaagggtcaggcagaaagcgtgatagaggagagaatttttgacaaaactcaaaagttgtttgcacagctgttctttgtaccctgttcctttctctgcgccctcctgtttctcccttgcctggaagtcattccaccctcaatttgttgatccacaagtttccagttgtcctcttctttttgttatagcatctctctatttcaaagacattcctagaagtcatccttcagtgatatcaccacttgctcagtcaccatctcaaccttatgtcacctcagccctcatctcaatgcccaaaccccttacacacaccttcagttagcttcaactgcctccgtttccacactgtgcacctttcactttccctacccagctttcctacatgctgcctctcctcagggtcccctgaatgctgcatcattgtgttcagtgcagctggactgattgcacctgtgtatttgcccctgagcactttcctttacacatgtggcttgtcttgccaatagactccaggcttataccttccatttccatcgtattctccagtttccaggatagacgttgctcatcgtctttacctaataaataagtttgtctgattgctg

SEQ ID NO: 112515 - DNA, 2266 bp, Homo sapiens
  Payload ID: 2017
  Gene Symbol: BTN1A1
  Gene Name: butyrophilin, subfamily 1, member A1
  ENST ID: ENST00000613186
  CDS Start-End: 21-1505
ctgctccagaagggtgggagatggcagttttcccaagctccggtctccccagatgtctgctcaccctcattctcctccagctgcccaaactggattcagctccctttgacgtgattggacccccggagcccatcctggccgttgtgggtgaggacgccgagctgccctgtcgcctgtctccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctgctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctgcgaaaaatgtgtcctgctacatccagaatctccttcttggccaggagaagaaagtagaaatatccataccagcttcctccctcccaaggctgactccctggatagtggctgtggctgtcatcctgatggttctaggacttctcaccattgggtccatatttttcacttggagactatacaacgaaagacccagagagaggaggaatgaattcagctctaaagagagactcctggaagaactcaaatggaaaaaggctaccttgcatgcagttgatgtgactctggacccagacacagctcatccccacctctttctttatgaggattcaaaatctgttcgactggaagattcacgtcagaaactgcctgagaaaacagagagatttgactcctggccctgtgtgttgggccgtgagaccttcacctcaggaaggcattactgggaggtggaggtgggagacaggactgactgggcaatcggcgtgtgtagggagaatgtgatgaagaaaggatttgaccccatgactcctgagaatgggttctgggctgtagagttgtatggaaatgggtactgggccctcactcctctccggacccctctcccattggcagggcccccacgccgggttgggattttcctagactatgaatcaggagacatctccttctacaacatgaatgatggatctgatatctatactttctccaatgtcacagtcattgctaatgcccaggacctttctaaggagatcccattgtcccccatgggggaggactctgcccctagggatgcagacactctccattctaagctaatccctacccaacccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaactcaaaggacagattagggatcgagattgggtcaggttagcatggggttgtggttgaaatatcttggtatccaggataagggtatgtggaaaaacaggctttaggcaagtggaaaattcaaaatgtgctgtgaaaggacaatctcaggctgaaatcccataaaggaacttggagggaatattatgatggagggaagtgaggtgaatccaggcacatgatgaacacctggctcatccatagagttttcacagcctatatcgcaaattttctaagccacgtcctataggacagaggagactggccccacttctatgggtctgagctgtggaaaagggagagcagagaggaactgagatgagcagggatgaagggtcaggcagaaagcgtgatagaggagagaatttttgacaaaactcaaaagttgtttgcacagctgttctttgtaccctgttcctttctctgcgccctcctgtttctccctt

SEQ ID NO: 112516 - DNA, 2920 bp, Homo sapiens
  Payload ID: 2018
  Gene Symbol: BTN2A1
  Gene Name: butyrophilin, subfamily 2, member A1
  Uniprot ID: Q7KYR7
  ENST ID: ENST00000312541
  CDS Start-End: 249-1832
actcttgggactgtggaagcccaggagaccagatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtg

SEQ ID NO: 112517 - DNA, 2989 bp, Homo sapiens
  Payload ID: 2018
  Gene Symbol: BTN2A1
  Gene Name: butyrophilin, subfamily 2, member A1
  ENST ID: ENST00000377600
  CDS Start-End: 252-707
ggaactcttgggactgtggaagcccaggagaccagatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcagagcttctggaagctgaggtctactgagaagtcgtcccagaagcagaaagtgaaatccaaaacctgcctgtttgaagttggagtcgacacacccatctcaaagactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatgg

SEQ ID NO: 112518 - DNA, 3113 bp, Homo sapiens
  Payload ID: 2018
  Gene Symbol: BTN2A1
  Gene Name: butyrophilin, subfamily 2, member A1
  Uniprot ID: Q7KYR7
  ENST ID: ENST00000429381
  CDS Start-End: 213-1217
cgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgagctccaattcttctcaaactgagagaactgcttctgtctctggagagacagaagtgcagcttcagtaattctcagtgtgtgagctgcctaggatcagagagccttcatggaagtggccactacgtggggatcccttcagagatatctgagacctctctggggatcaggaaccacacaatccccagggttcctgagaccccaggcctaaacctgagacttcctctgcagttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtg

SEQ ID NO: 112519 - DNA, 687 bp, Homo sapiens
  Payload ID: 2018
  Gene Symbol: BTN2A1
  Gene Name: butyrophilin, subfamily 2, member A1
  ENST ID: ENST00000480218
  CDS Start-End: 1-236
ctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgggtggtgagtgggtgctgatggcagcctggtttgaaaatctccactggagagaagacacagcaggattcagatgcaaatgaccagagcactccaagttggaaagaactgctgagcgggtctgtagagcccatcgctctctcctgtctattcatcagctaggctgaagctcctgacagactcacaccagtatcttgctgctccagaaaggtcgaagatggcagttttcccaaactccggcttgcccagatgtctgctcaccctcattcttctccagctgcccaagctggtttcagataggtctctctctctggcctgcagagttaaaacatctcaataaatataaagtataaaaagaagctggagcccaaccacttcggcacatgttcacaggatctcggggctgtgtcacaagccactgggcactcatatctggctgagaataaatctcttgcaatatt

SEQ ID NO: 112520 - DNA, 1687 bp, Homo sapiens
  Payload ID: 2018
  Gene Symbol: BTN2A1
  Gene Name: butyrophilin, subfamily 2, member A1
  Uniprot ID: Q7KYR7
  ENST ID: ENST00000469185
  CDS Start-End: 206-1198
tgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgggccagtttgaagctttatatatcatttaccaaacttagggtggtgagtgggtgctgatggcagcctggtttgaaaatctccactggagagaagacacagcaggattcagatgcaaatgaccagagcactccaagttggaaagaactgctgagcgggtctgtagagcccatcgctctctcctgtctattcatcagctaggctgaagctcctgacagactcacaccagtatcttgctgctccagaaaggtcgaagatggcagttttcccaaactccggcttgcccagatgtctgctcaccctcattcttctccagctgcccaagctggtttcagataggtctctctctctggcctgcagagttaaaacatctcaataaatataaagtataaaaagaagctggagcccaaccacttcggcacatgttcacaggatctcggggctgtgtcacaagccactgggcactcatatctggctgagaataaatctcttgcaatatttt

SEQ ID NO: 112521 - DNA, 551 bp, Homo sapiens
  Payload ID: 2018
  Gene Symbol: BTN2A1
  Gene Name: butyrophilin, subfamily 2, member A1
  ENST ID: ENST00000493173
  CDS Start-End: 295-551
agaccagatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctc

SEQ ID NO: 112522 - DNA, 2845 bp, Homo sapiens
  Payload ID: 2018
  Gene Symbol: BTN2A1
  Gene Name: butyrophilin, subfamily 2, member A1
  Uniprot ID: Q7KYR7
  ENST ID: ENST00000541522
  CDS Start-End: 341-1741
gggctctaaaatacttagggaactcttgggactgtggaagcccaggagaccagatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtggcattgattaactttt

SEQ ID NO: 112523 - DNA, 3241 bp, Homo sapiens
  Payload ID: 2019
  Gene Symbol: BTN2A2
  Gene Name: butyrophilin, subfamily 2, member A2
  Uniprot ID: Q8WVV5
  ENST ID: ENST00000352867
  CDS Start-End: 111-1334
aatcttgggactttttggacacccagagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtgacactggttaactttttccagatctcatgtctggcttaataagagatatttgtattatcatatctgcctttgtattaaacctattggtatatcataggtcatgttagctcaaaaaaactttactgcacactactgagagaatgagatgaaaaacgattaatgtttcattattattattgtgaaaatattattaacactggggactccttaagagtacatcagagttctctctaggaatcccaaaaccacattttgaaactagaatagtggatcctggaagttaatccatgtgctggttaattttagatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaa

SEQ ID NO: 112524 - DNA, 3590 bp, Homo sapiens
  Payload ID: 2019
  Gene Symbol: BTN2A2
  Gene Name: butyrophilin, subfamily 2, member A2
  Uniprot ID: Q8WVV5
  ENST ID: ENST00000356709
  CDS Start-End: 112-1683
aaatcttgggactttttggacacccagagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtgacactggttaactttttccagatctcatgtctggcttaataagagatatttgtattatcatatctgcctttgtattaaacctattggtatatcataggtcatgttagctcaaaaaaactttactgcacactactgagagaatgagatgaaaaacgattaatgtttcattattattattgtgaaaatattattaacactggggactccttaagagtacatcagagttctctctaggaatcccaaaaccacattttgaaactagaatagtggatcctggaagttaatccatgtgctggttaattttagatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaa

SEQ ID NO: 112525 - DNA, 1570 bp, Homo sapiens
  Payload ID: 2019
  Gene Symbol: BTN2A2
  Gene Name: butyrophilin, subfamily 2, member A2
  Uniprot ID: Q8WVV5
  ENST ID: ENST00000432533
  CDS Start-End: 87-857
agagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgggtatgagctgcctgggatcaggggaccttcatggaaacggccactacatggggaacccccttcagctttctgagacttctctggggaccaggaaccacacaatccccagggttcctgagaccccaggcataaacctgagacttcctctgcagctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctgg

SEQ ID NO: 112526 - DNA, 2733 bp, Homo sapiens
  Payload ID: 2019
  Gene Symbol: BTN2A2
  Gene Name: butyrophilin, subfamily 2, member A2
  Uniprot ID: Q8WVV5
  ENST ID: ENST00000416795
  CDS Start-End: 137-1708
gggatgctttgttgtctggtggtgactgtgcccatgggtgagttgtatcggaaaatcgtcatgtgaggatcagaggggaaaagaaaacagaggttagttctagaaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtga

SEQ ID NO: 112527 - DNA, 3297 bp, Homo sapiens
  Payload ID: 2019
  Gene Symbol: BTN2A2
  Gene Name: butyrophilin, subfamily 2, member A2
  ENST ID: ENST00000495632
  CDS Start-End: 1-171
ttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctggtgagtgcctctgatgttctctcagatctcagctttctccccactagccagctaacaggactccttagaggagatgagcaaggggcccagggctacacagggaccatagggaactggggtcagttcatcaacggtgtcccagcaatgatgcatcatggctcttctgtcagggaaccccagcagctcttaatgaaccctgcagtttacatccccaggaccctttctcttttggaataatttaatgcatgattatcaaaggtttcccatgcatagtagcctcctaagagttacatttcagaagtcattgctctttgattctggatcaatttgaaataagataatgctgtcttagcaattcatatcctgggaatggtatagactgtgcacagttgaagacctatgtgaggaaaaggccataagggtccccagtaagcctgatgcaatggtgtacaaataggtggccagaaatacctttctgcctctaagagagcactgatattctgcatgtagtctgccaggggaaggggtttgggtgagtgggagggtgagtgggagagcacagagaaaccaatcgcccacttccagtgagttctcatcttgtgattcggcacctctgcctgtcagcaccaaagaatccaaactttaccagataccagggcccatggacctttcctctttggcgagtttcaaaattgccactgtcattttgggacacaatcacaacttgtcacaatcagacatatcaacttgtggaaaagagaaaatcattttaatgcaatagaaaggtagactgaataagtaagaatacatgcagaaggtagaggtttgcagaatgctcagctcctggggcttttcctgtatgggagaagtaatcctggtagatgtcagactcatattgttaaagcaaaactggattgaagtatttcttccctaactttgcccacacatccctcaggcaccaggttttcttttgcacacatttattctccttctttatcctttgaagtgtgcccttgtcagccacttaaatcagttgtcacctattaaaacaacctataggaccaacgaagaggtccttcaccacctaggacagtgtgtaatgatagactcacttaattgatccattgagaggtatgtgggggaacaataggagataaagcttctgtgatggtttaagccaagttggaaagtttctaactaaagaaagtcccagagatcatatatcttgaatagaaaagggatcagatcttagaatgctgagaaaaactgggaaccattaattttggctcatttcctaaactctctggatttcatagagccacaattcttctcaacctgggggcactgcttctgtctctggagagatagaagtgcagcttccgtaattctcagggtatgagctgcctgggatcaggggaccttcatggaaacggccactacatggggaacccccttcagctttctgagacttctctggggaccaggaaccacacaatccccagggttcctgagaccccaggcataaacctgagacttcctctgcagctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtcc

SEQ ID NO: 112528 - DNA, 1790 bp, Homo sapiens
  Payload ID: 2019
  Gene Symbol: BTN2A2
  Gene Name: butyrophilin, subfamily 2, member A2
  Uniprot ID: Q8WVV5
  ENST ID: ENST00000469230
  CDS Start-End: 235-1245
agtggaaatcttgggactttttggacacccagagaacaggtcccagataccgagtccgcaactccaaacatcgcgattaataggaggtgaacacagcttttctcttctctttgggatgctttgttgtctggtggtgactgtgcccatgggtgagttgtatcggaaaatcgtcatgtgaggatcagaggggaaaagaaaacagaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaa

SEQ ID NO: 112529 - DNA, 540 bp, Homo sapiens
  Payload ID: 2019
  Gene Symbol: BTN2A2
  Gene Name: butyrophilin, subfamily 2, member A2
  ENST ID: ENST00000494184
  CDS Start-End: 252-540
gttgtctggtggtgactgtgcccatgggtgagttgtatcggaaaatcgtcatgtgaggatcagaggggaaaagaaaacagagatacctgagccttgagatgcaagcgactcccagaagttggggcaccgatgagacctacttgagtgacaggagaggttgggcccgaccagcactgaggtgccaagactcctaggctgattctcctcctctgtaaccctaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtacc

SEQ ID NO: 112530 - DNA, 587 bp, Homo sapiens
  Payload ID: 2019
  Gene Symbol: BTN2A2
  Gene Name: butyrophilin, subfamily 2, member A2
  ENST ID: ENST00000482842
  CDS Start-End: 346-587
agaacaggtcccagataccgagtccgcaactccaaacatcgcgattaataggaggtgaacacagcttttctcttctctttgggatgctttgttgtctggtggtgactgtgcccatgggtgagttgtatcggaaaatcgtcatgtgaggatcagaggggaaaagaaaacagaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcat

SEQ ID NO: 112531 - DNA, 942 bp, Homo sapiens
  Payload ID: 2019
  Gene Symbol: BTN2A2
  Gene Name: butyrophilin, subfamily 2, member A2
  ENST ID: ENST00000483410
  CDS Start-End: 390-942
ctggtggggaggcgcagcctcgcctggctttacctcgagtgtcccgacctgggtctcggggagggggaagtggagggacgagggtgtgaaagaatccagggacaactgaagaaaccggactgtggcccgagaagtgggaagaggaaggaggaaaacggcccccttgatctctgcattgatggcttacttatggaatgtttacggaatccctctttcggagatacctgagccttgagatgcaagcgactcccagaagttggggcaccgatgagacctacttgagtgacaggagaggttgggcccgaccagcactgaggtgccaagactcctaggctgattctcctcctctgtaaccctaggcctctggtctctgcctgccctgggtgctcatggaaccagctgctgctctgcacttctccctgccagcctccctcctcctcctcctgctcctcctccttctcagcctgtgtgcactggtctcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaaga

SEQ ID NO: 112532 - DNA, 600 bp, Homo sapiens
  Payload ID: 2019
  Gene Symbol: BTN2A2
  Gene Name: butyrophilin, subfamily 2, member A2
  ENST ID: ENST00000471116
  CDS Start-End: 140-259
gcttttctcttctctttgggatgctttgttgtctggtggtgactgtgcccatgggtgagttgtatcggaaaatcgtcatgtgaggatcagaggggaaaagaaaacagaggcctctggtctctgcctgccctgggtgctcatggaaccagctgctgctctgcacttctccctgccagcctccctcctcctcctcctgctcctcctccttctcagcctgtgtgcactggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggttt

SEQ ID NO: 112533 - DNA, 881 bp, Homo sapiens
  Payload ID: 2019
  Gene Symbol: BTN2A2
  Gene Name: butyrophilin, subfamily 2, member A2
  ENST ID: ENST00000493275
  CDS Start-End: 163-881
tttttggacacccagagaacaggtcccagataccgagtccgcaactccaaacatcgcgattaataggaggtgaacacagcttttctcttctctttgggatgctttgttgtctggtggtgactgtgcccatgggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttat

SEQ ID NO: 112534 - DNA, 966 bp, Homo sapiens
  Payload ID: 2019
  Gene Symbol: BTN2A2
  Gene Name: butyrophilin, subfamily 2, member A2
  ENST ID: ENST00000490025
  CDS Start-End: 255-966
aaatcttgggactttttggacacccagagaacaggtcccagataccgagtccgcaactccaaacatcgcgattaataggaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccc

SEQ ID NO: 112535 - DNA, 535 bp, Homo sapiens
  Payload ID: 2019
  Gene Symbol: BTN2A2
  Gene Name: butyrophilin, subfamily 2, member A2
  ENST ID: ENST00000472507
  CDS Start-End: 205-535
agagaacaggtcccagataccgagtccgcaactccaaacatcgcgattaataggaggtgaacacagcttttctcttctctttgggatgctttgttgtctggtggtgactgtgcccatgggtgagttgtatcggaaaatcgtcatgtgaggatcagaggggaaaagaaaacagaggcctctggtctctgcctgccctgggtgctcatggaaccagctgctgctctgcacttctccctgccagcctccctcctcctcctcctgctcctcctccttctcagcctgtgtgcactggtctcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaaca

SEQ ID NO: 112536 - DNA, 1068 bp, Homo sapiens
  Payload ID: 2019
  Gene Symbol: BTN2A2
  Gene Name: butyrophilin, subfamily 2, member A2
  Uniprot ID: Q8WVV5
  ENST ID: ENST00000482536
  CDS Start-End: 87-1028
agagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctg

SEQ ID NO: 112537 - DNA, 3434 bp, Homo sapiens
  Payload ID: 2020
  Gene Symbol: BTN3A1
  Gene Name: butyrophilin, subfamily 3, member A1
  Uniprot ID: O00481
  ENST ID: ENST00000289361
  CDS Start-End: 369-1910
aatcaaaaaacttattcttccaaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacgcactgaagcactttactgatactcattcaattattcatatgacagttgtttgagtttggtaccatcttattttccccttatacagataaggaaactggggtgcagaaaagtgaattgactacaaagtagacatgactagttaacaacacagctgggatctaaacagcaataactaacattaatggagaacttaaaatgctctgagtgctgtgttatgagctttggtggatgtcactcctttaatcctcgcaacaccctgtcgggtagtctcatttagcaagtatggaagttgaggcagggcaacattaagcaacttacataactcatgcagtaatttctgcagttgggagatgttcagcttcagtccccggccctatggccgttcttttccaccctgtttcttcccccataggaagaacccacctgtagccctgaggttcttttcccaggatggctccaggataaggatcactgtaggtggttgtggagttgacacccctgttgactccttcccagctgattgtcagagccttagacccagcacgccttggattagctctgcagagtgtcttggttgagagaataacctcaccgtacccacatgacacgtgatttggaaagagactagaggccacacttgataaatcatggggaacagatgtgttccacccaacaaatgtgataagtgatcatgcagccagagccagccttccttcaatcaaggtttccaggcagagcaaataccctagagattctctgtgatataggaaatttggatgaagggagctagaagaaatacagggatttttttttttttttaagatggagtcttactctgttgctaggctggagtgcagtggtgcgatctcagctccctgcaacctccacctcctgggttcaaacaattctcctgcctcagcctcccgagtactgggaatataggtgcacgccaccacacccaacaaatttttgtacttttagtacagatgagggttcactatgttggccaggatggtctcgatctcttgacctcatgatccacccacctcggtctcccaaagtgctgggattacaggcttgagccaccgggtgaccggcttacagggatatttttaatcccgttatggactctgtctccaggagaggggtctatccacccctgctcattggtggatgttaaaccaatattcctttcaactgctgcctgctagggaaaaactactcctcattatcatcattattattgctctccactgtatcccctctacctggcatgtgcttgtcaagttctagttgttcaataaatttgttaataatgctgactcttcaa

SEQ ID NO: 112538 - DNA, 580 bp, Homo sapiens
  Payload ID: 2020
  Gene Symbol: BTN3A1
  Gene Name: butyrophilin, subfamily 3, member A1
  ENST ID: ENST00000450085
  CDS Start-End: 224-580
attcttccaaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctct

SEQ ID NO: 112539 - DNA, 1882 bp, Homo sapiens
  Payload ID: 2020
  Gene Symbol: BTN3A1
  Gene Name: butyrophilin, subfamily 3, member A1
  Uniprot ID: O00481
  ENST ID: ENST00000425234
  CDS Start-End: 356-1492
attcttccaaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgggcctcccattggccaaacccaacagcaaaccagaggacaagggagcccagtggcactgtctcaggaatctgcccagaggacagattcctggggcccagaagagggtggagaaagctgaagggtggagagtgaatctagggcatataaggcaccacatagagcccagcacagagacggccttgcagctatcaggaagatgaggagcttccttcatggcctgctgtgggctgagtaaataacatgattgccttctacagcgctagagattcatttgtttatccccatttttcaggtgaggaaatgcttcagatgaggctccactttgttaaataaattggatgtatggaaaaatagactgcagaaaaggggaactcatttagctcatgagtggtcgaatgaaggttgaaaattaacctctgagtataaagcattagtgggcagagtgaatatggggagggaaacaagaaaaacgtagaaaggatccttgctgcttcctgaggccgcgtca

SEQ ID NO: 112540 - DNA, 570 bp, Homo sapiens
  Payload ID: 2020
  Gene Symbol: BTN3A1
  Gene Name: butyrophilin, subfamily 3, member A1
  ENST ID: ENST00000427334
  CDS Start-End: 441-570
aaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagagatcttgttctcagaggccattcccagacccacagcaagagggattatggctgcaggcctcatgctcctttgttttggaagaaactgttgaggagtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatgg

SEQ ID NO: 112541 - DNA, 2077 bp, Homo sapiens
  Payload ID: 2020
  Gene Symbol: BTN3A1
  Gene Name: butyrophilin, subfamily 3, member A1
  Uniprot ID: O00481
  ENST ID: ENST00000414912
  CDS Start-End: 311-1696
agtctctgctttctttttcctttcttccagaaggagatttaaccatagtagaaagaatggagaactattaactgcctttcttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacgcactgaagcactttactgatactcattcaattattcatatgacagttgtttgagtttggtaccatcttattttccccttatacagataaggaaactggggtgcagaaaagtgaattgactacaaagtagacatgactagttaacaacacagctgggatctaaacagcaataactaacattaatggag

SEQ ID NO: 112542 - DNA, 1758 bp, Homo sapiens
  Payload ID: 2020
  Gene Symbol: BTN3A1
  Gene Name: butyrophilin, subfamily 3, member A1
  Uniprot ID: O00481
  ENST ID: ENST00000476549
  CDS Start-End: 199-1257
aatcaaaaaacttattcttccaaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctggtgaggaaatgcttcagatgaggctccactttgttaaataaattggatgtatggaaaaatagactgcagaaaaggggaactcatttagctcatgagtggtcgaatgaaggttgaaaattaacctctgagtataaagcattagtgggcagagtgaatatggggagggaaacaagaaaaacgtagaaaggatccttgctgcttcctgaggccgcgtcagggtattgggttaggcagagatgctgaggcaaccctcatttcaccctcctcttcccctctggacacaagatacctgatacctggggctttctctcctgacatcgatgagagagtcacatttagggcagactagggacaccaggctttggactcagacctcctcagcatggcccaggccttgcatgctgaggctctgaaatccaggaaaaatggttgacctcatggacacttcctcaaactctctgcagcggatgtgattctggatccaaaaacagcaaaccccatcctccttgtttctgaggaccagaggagtgtgcagcgtgcca

SEQ ID NO: 112543 - DNA, 619 bp, Homo sapiens
  Payload ID: 2020
  Gene Symbol: BTN3A1
  Gene Name: butyrophilin, subfamily 3, member A1
  ENST ID: ENST00000506698
  CDS Start-End: 345-619
attcctcacgatgacccgacagtctctgctttctttttcctttcttccagaaggagatttaaccatagtagaaagaatggagaactattaactgcctttcttctgtgggctgtgattttcagaggggaatgctaagagacatgtttttacaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcacc

SEQ ID NO: 112544 - DNA, 3017 bp, Homo sapiens
  Payload ID: 2021
  Gene Symbol: BTN3A2
  Gene Name: butyrophilin, subfamily 3, member A2
  Uniprot ID: P78410
  ENST ID: ENST00000356386
  CDS Start-End: 189-1193
atttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctgactcttc

SEQ ID NO: 112545 - DNA, 1634 bp, Homo sapiens
  Payload ID: 2021
  Gene Symbol: BTN3A2
  Gene Name: butyrophilin, subfamily 3, member A2
  Uniprot ID: P78410
  ENST ID: ENST00000377708
  CDS Start-End: 156-1160
gaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaa

SEQ ID NO: 112546 - DNA, 3672 bp, Homo sapiens
  Payload ID: 2021
  Gene Symbol: BTN3A2
  Gene Name: butyrophilin, subfamily 3, member A2
  Uniprot ID: P78410
  ENST ID: ENST00000396934
  CDS Start-End: 179-1114
acctctgagccaatcaaaaaactaattcttccaaagagcgactcttactgtttctcatggtgagaagacaatatttgctttctctttttcctttcttccggatgagaggctaagccataatagaaagaatggagaattattgattgaccgtctttattctgtgggctctgattctccaatgggaataccaagggctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctgactcttcaa

SEQ ID NO: 112547 - DNA, 1494 bp, Homo sapiens
  Payload ID: 2021
  Gene Symbol: BTN3A2
  Gene Name: butyrophilin, subfamily 3, member A2
  Uniprot ID: P78410
  ENST ID: ENST00000396948
  CDS Start-End: 154-1158
ggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctgggcctcccattggccaaacacagcagcaaaccagaggacaagggagcccagtggcactgtccatagaggacagattcctggggtccagaagagggtggagaaagctgaaggctggagagtgaatctagggcatataaggccccacacagagcccagcacagagacggccttgcagctatcaggaagatgaggagcttccttcatggcctgctgtgggctgagtaaataatatgattgccttctacagcgctagagattcatatgtttatccccatttttcaggtgaggaaatgcttcagatg

SEQ ID NO: 112548 - DNA, 1460 bp, Homo sapiens
  Payload ID: 2021
  Gene Symbol: BTN3A2
  Gene Name: butyrophilin, subfamily 3, member A2
  Uniprot ID: P78410
  ENST ID: ENST00000527422
  CDS Start-End: 199-1203
atttgctttctctttttcctttcttccggatgagaggctaagccataatagaaagaatggagaattattgattgaccgtctttattctgtgggctctgattctccaatgggaataccaagggatattatttttacagatggttttccatactggaacccaaaggtaaagacactcaaggacagacatttttggcagagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctgggcctcccattggccaaacacagcagcaaaccagaggacaagggagcccagtggcactgtccatagaggacagattcctggggtccagaagagggtggagaaagctgaaggctggagagtgaatctagggcatataaggccccacacagagcccagcacagagacggccttgcagctatcaggaagatgaggagcttccttcatggcctgctgtgggctgagt

SEQ ID NO: 112549 - DNA, 593 bp, Homo sapiens
  Payload ID: 2021
  Gene Symbol: BTN3A2
  Gene Name: butyrophilin, subfamily 3, member A2
  ENST ID: ENST00000527417
  CDS Start-End: 115-593
aatcaaaaaactaattcttccaaagagcgactcttactgtttctcatgatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagaccccttcttcaggagcgcccagccctggatcgcagccctggcagg

SEQ ID NO: 112550 - DNA, 515 bp, Homo sapiens
  Payload ID: 2021
  Gene Symbol: BTN3A2
  Gene Name: butyrophilin, subfamily 3, member A2
  ENST ID: ENST00000524459
  CDS Start-End: 192-323
aatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcaggattgtgttcccctctaggttctctgtatctcgccttccctgtctgagaaggacccttcctctcatgaccccaactccaaaaccctctgatggagcttcccccttgtgctgacagctcagttttctgtgcttggaccctctgggcccatcctggccatgatggaaaggaagtggaagacaggcagagtgcaccgtatcgagggagaacttcgattctgcgggatggcatcactgcaggg

SEQ ID NO: 112551 - DNA, 496 bp, Homo sapiens
  Payload ID: 2021
  Gene Symbol: BTN3A2
  Gene Name: butyrophilin, subfamily 3, member A2
  ENST ID: ENST00000530653
  CDS Start-End: 151-496
aatcaaaaaactaattcttccaaagagcgactcttactgtttctcatgatggttttccatactggaacccaaaggtaaagacactcaaggacagacatttttggcagagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatg

SEQ ID NO: 112552 - DNA, 885 bp, Homo sapiens
  Payload ID: 2021
  Gene Symbol: BTN3A2
  Gene Name: butyrophilin, subfamily 3, member A2
  ENST ID: ENST00000532865
  CDS Start-End: 297-885
acctctgagccaatcaaaaaactaattcttccaaagagcgactcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcag

SEQ ID NO: 112553 - DNA, 3733 bp, Homo sapiens
  Payload ID: 2021
  Gene Symbol: BTN3A2
  Gene Name: butyrophilin, subfamily 3, member A2
  Uniprot ID: P78410
  ENST ID: ENST00000508906
  CDS Start-End: 297-1175
acctctgagccaatcaaaaaactaattcttccaaagagcgactcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctgactcttcaa

SEQ ID NO: 112554 - DNA, 509 bp, Homo sapiens
  Payload ID: 2021
  Gene Symbol: BTN3A2
  Gene Name: butyrophilin, subfamily 3, member A2
  ENST ID: ENST00000527639
  CDS Start-End: 1-348
agaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtgagtggctttgacattttctctgaattcaaatctgttactctctctctgcttcattattttccagcccataagtcatagcccagggttgaaaagtggtcttggatccctttacccagaaaaagaaaacaagtgtggctctttggagaaaccacccagtgctttttctctctag

SEQ ID NO: 112555 - DNA, 3002 bp, Homo sapiens
  Payload ID: 2022
  Gene Symbol: BTN3A3
  Gene Name: butyrophilin, subfamily 3, member A3
  Uniprot ID: O00478
  ENST ID: ENST00000244519
  CDS Start-End: 244-1998
aatcaaaaaactaattcttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagaagctccaggaggaactcaagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgctta

SEQ ID NO: 112556 - DNA, 2294 bp, Homo sapiens
  Payload ID: 2022
  Gene Symbol: BTN3A3
  Gene Name: butyrophilin, subfamily 3, member A3
  Uniprot ID: O00478
  ENST ID: ENST00000361232
  CDS Start-End: 283-1890
cttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagag

SEQ ID NO: 112557 - DNA, 671 bp, Homo sapiens
  Payload ID: 2022
  Gene Symbol: BTN3A3
  Gene Name: butyrophilin, subfamily 3, member A3
  ENST ID: ENST00000494393
  CDS Start-End: 259-671
aatcaaaaaactaattcttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaaatattatttttacagatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccct

SEQ ID NO: 112558 - DNA, 697 bp, Homo sapiens
  Payload ID: 2022
  Gene Symbol: BTN3A3
  Gene Name: butyrophilin, subfamily 3, member A3
  ENST ID: ENST00000471353
  CDS Start-End: 276-697
aaaaaactaattcttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaa

SEQ ID NO: 112559 - DNA, 626 bp, Homo sapiens
  Payload ID: 2022
  Gene Symbol: BTN3A3
  Gene Name: butyrophilin, subfamily 3, member A3
  ENST ID: ENST00000482451
  CDS Start-End: 244-626
aatcaaaaaactaattcttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagcatagatgaaaatggcaagttccctggctttccttctgctcaactttcatgtctccctcttcttggtccagctgctcactccttgctcagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcatt

SEQ ID NO: 112560 - DNA, 883 bp, Homo sapiens
  Payload ID: 2022
  Gene Symbol: BTN3A3
  Gene Name: butyrophilin, subfamily 3, member A3
  ENST ID: ENST00000487272
  CDS Start-End: 133-883
gaatgagagactcaaccataatagaaagaatggagaactattaaccaccattcttcagtgggctgtgattttcagaggggaatactaagaactcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaa

SEQ ID NO: 112561 - DNA, 765 bp, Homo sapiens
  Payload ID: 2022
  Gene Symbol: BTN3A3
  Gene Name: butyrophilin, subfamily 3, member A3
  ENST ID: ENST00000490254
  CDS Start-End: 135-765
cggaatgagagactcaaccataatagaaagaatggagaactattaaccaccattcttcagtgggctgtgattttcagaggggaatactaagaactcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaag

SEQ ID NO: 112562 - DNA, 1002 bp, Homo sapiens
  Payload ID: 2022
  Gene Symbol: BTN3A3
  Gene Name: butyrophilin, subfamily 3, member A3
  ENST ID: ENST00000496719
  CDS Start-End: 290-1002
agagattgttattattcctcacaataaccagatagcctctgctttctttttcctttcttcggaatgagagactcaaccataatagaaagaatggagaactattaaccaccattcttcagtgggctgtgattttcagaggggaatactaagaagtaagtggggaatgttgattagagcctgggctacaatgcctgggaggacaagagctgaatcgctgagagtgatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgc

SEQ ID NO: 112563 - DNA, 626 bp, Homo sapiens
  Payload ID: 2022
  Gene Symbol: BTN3A3
  Gene Name: butyrophilin, subfamily 3, member A3
  ENST ID: ENST00000487627
  CDS Start-End: 326-626
agagattgttattattcctcacaataaccagatagcctctgctttctttttcctttcttcggaatgagagactcaaccataatagaaagaatggagaactattaaccaccattcttcagtgggctgtgattttcagaggggaatactaagaagtaagtggggaatgttgattagagcctgggctacaatgcctgggaggacaagagctgaatcgctgagagtgatggttttccatactggaacccaaaggtaaagacactcaaggacagacatttttggcagagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaagg

SEQ ID NO: 112564 - DNA, 1368 bp, Homo sapiens
  Payload ID: 2023
  Gene Symbol: BTNL2
  Gene Name: butyrophilin-like 2
  Uniprot ID: Q9UIR0
  ENST ID: ENST00000374993
  CDS Start-End: 1-1368
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagataaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 112565 - DNA, 333 bp, Homo sapiens
  Payload ID: 2023
  Gene Symbol: BTNL2
  Gene Name: butyrophilin-like 2
  ENST ID: ENST00000433988
  CDS Start-End: 8-333
agggaggatggtggattttccaggctacaatctgtctggtgcagtcgcctccttcctattcatcctgctgacaatgaagcagtcagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaa

SEQ ID NO: 112566 - DNA, 331 bp, Homo sapiens
  Payload ID: 2023
  Gene Symbol: BTNL2
  Gene Name: butyrophilin-like 2
  ENST ID: ENST00000446536
  CDS Start-End: 6-331
ggaggatggtggattttccaggctacaatctgtctggtgcagtcgcctccttcctattcatcctgctgacaatgaagcagtcagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaa

SEQ ID NO: 112567 - DNA, 1460 bp, Homo sapiens
  Payload ID: 2023
  Gene Symbol: BTNL2
  Gene Name: butyrophilin-like 2
  ENST ID: ENST00000454136
  CDS Start-End: 6-1454
ggaggatggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagataaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacgtttttgtggaaaacactgcttgtttggggattgcttcttgctgtggctgtaggcctgcccaggaagaggagctgaaaagag

SEQ ID NO: 112568 - DNA, 846 bp, Homo sapiens
  Payload ID: 2023
  Gene Symbol: BTNL2
  Gene Name: butyrophilin-like 2
  ENST ID: ENST00000435335
  CDS Start-End: 1-207
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 112569 - DNA, 846 bp, Homo sapiens; identical to SEQ ID NO: 112568
  Payload ID: 2023
  Gene Symbol: BTNL2
  Gene Name: butyrophilin-like 2
  ENST ID: ENST00000427760
  CDS Start-End: 1-207

SEQ ID NO: 112570 - DNA, 333 bp, Homo sapiens; identical to SEQ ID NO: 112565
  Payload ID: 2023
  Gene Symbol: BTNL2
  Gene Name: butyrophilin-like 2
  ENST ID: ENST00000429303
  CDS Start-End: 8-333

SEQ ID NO: 112571 - DNA, 846 bp, Homo sapiens
  Payload ID: 2023
  Gene Symbol: BTNL2
  Gene Name: butyrophilin-like 2
  ENST ID: ENST00000457589
  CDS Start-End: 1-207
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 112572 - DNA, 846 bp, Homo sapiens; identical to SEQ ID NO: 112571
  Payload ID: 2023
  Gene Symbol: BTNL2
  Gene Name: butyrophilin-like 2
  ENST ID: ENST00000452747
  CDS Start-End: 1-207

SEQ ID NO: 112573 - DNA, 1462 bp, Homo sapiens
  Payload ID: 2023
  Gene Symbol: BTNL2
  Gene Name: butyrophilin-like 2
  ENST ID: ENST00000445928
  CDS Start-End: 8-1456
agggaggatggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagataaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacgtttttgtggaaaacactgcttgtttggggattgcttcttgctgtggctgtaggcctgcccaggaagaggagctgaaaagag

SEQ ID NO: 112574 - DNA, 1462 bp, Homo sapiens
  Payload ID: 2023
  Gene Symbol: BTNL2
  Gene Name: butyrophilin-like 2
  ENST ID: ENST00000416387
  CDS Start-End: 8-1456
agggaggatggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagatgaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacgtttttgtggaaaacactgcttgtttggggattgcttcttgctgtggctgtaggcctgcccaggaagaggagctgaaaagag

SEQ ID NO: 112575 - DNA, 1462 bp, Homo sapiens; identical to SEQ ID NO: 112574
  Payload ID: 2023
  Gene Symbol: BTNL2
  Gene Name: butyrophilin-like 2
  ENST ID: ENST00000443091
  CDS Start-End: 8-1456

SEQ ID NO: 112576 - DNA, 846 bp, Homo sapiens; identical to SEQ ID NO: 112568
  Payload ID: 2023
  Gene Symbol: BTNL2
  Gene Name: butyrophilin-like 2
  ENST ID: ENST00000451625
  CDS Start-End: 1-207

SEQ ID NO: 112577 - DNA, 333 bp, Homo sapiens; identical to SEQ ID NO: 112565
  Payload ID: 2023
  Gene Symbol: BTNL2
  Gene Name: butyrophilin-like 2
  ENST ID: ENST00000458467
  CDS Start-End: 8-333

SEQ ID NO: 112578 - DNA, 333 bp, Homo sapiens; identical to SEQ ID NO: 112565
  Payload ID: 2023
  Gene Symbol: BTNL2
  Gene Name: butyrophilin-like 2
  ENST ID: ENST00000425482
  CDS Start-End: 8-333

SEQ ID NO: 112579 - DNA, 333 bp, Homo sapiens; identical to SEQ ID NO: 112565
  Payload ID: 2023
  Gene Symbol: BTNL2
  Gene Name: butyrophilin-like 2
  ENST ID: ENST00000424222
  CDS Start-End: 8-333

SEQ ID NO: 112580 - DNA, 333 bp, Homo sapiens; identical to SEQ ID NO: 112565
  Payload ID: 2023
  Gene Symbol: BTNL2
  Gene Name: butyrophilin-like 2
  ENST ID: ENST00000446311
  CDS Start-End: 8-333

SEQ ID NO: 112581 - DNA, 846 bp, Homo sapiens; identical to SEQ ID NO: 112571
  Payload ID: 2023
  Gene Symbol: BTNL2
  Gene Name: butyrophilin-like 2
  ENST ID: ENST00000418649
  CDS Start-End: 1-207

SEQ ID NO: 112582 - DNA, 1466 bp, Homo sapiens
  Payload ID: 2023
  Gene Symbol: BTNL2
  Gene Name: butyrophilin-like 2
  ENST ID: ENST00000433826
  CDS Start-End: 8-1456
agggaggatggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagatgaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacgtttttgtggaaaacactgcttgtttggggattgcttcttgctgtggctgtaggcctgcccaggaagaggagctgaaaagaggtaa

SEQ ID NO: 112583 - DNA, 1462 bp, Homo sapiens; identical to SEQ ID NO: 112573
  Payload ID: 2023
  Gene Symbol: BTNL2
  Gene Name: butyrophilin-like 2
  ENST ID: ENST00000447918
  CDS Start-End: 8-1456

SEQ ID NO: 112584 - DNA, 1462 bp, Homo sapiens
  Payload ID: 2023
  Gene Symbol: BTNL2
  Gene Name: butyrophilin-like 2
  ENST ID: ENST00000416597
  CDS Start-End: 8-1456
agggaggatggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagataaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacatttttgtggaaaacactgcttgtttggggattgcttcttgctgtggctgtaggcctgcccaggaagaggagctgaaaagag

SEQ ID NO: 112585 - DNA, 1462 bp, Homo sapiens; identical to SEQ ID NO: 112573
  Payload ID: 2023
  Gene Symbol: BTNL2
  Gene Name: butyrophilin-like 2
  ENST ID: ENST00000422056
  CDS Start-End: 8-1456

SEQ ID NO: 112586 - DNA, 333 bp, Homo sapiens; identical to SEQ ID NO: 112565
  Payload ID: 2023
  Gene Symbol: BTNL2
  Gene Name: butyrophilin-like 2
  ENST ID: ENST00000415239
  CDS Start-End: 8-333

SEQ ID NO: 112587 - DNA, 846 bp, Homo sapiens; identical to SEQ ID NO: 112571
  Payload ID: 2023
  Gene Symbol: BTNL2
  Gene Name: butyrophilin-like 2
  ENST ID: ENST00000465865
  CDS Start-End: 1-207

SEQ ID NO: 112588 - DNA, 845 bp, Homo sapiens
  Payload ID: 2023
  Gene Symbol: BTNL2
  Gene Name: butyrophilin-like 2
  Uniprot ID: Q9UIR0
  ENST ID: ENST00000544175
  CDS Start-End: 309-845
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 112589 - DNA, 845 bp, Homo sapiens
  Payload ID: 2023
  Gene Symbol: BTNL2
  Gene Name: butyrophilin-like 2
  Uniprot ID: Q9UIR0
  ENST ID: ENST00000551669
  CDS Start-End: 309-845
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 112590 - DNA, 845 bp, Homo sapiens; identical to SEQ ID NO: 112589
  Payload ID: 2023
  Gene Symbol: BTNL2
  Gene Name: butyrophilin-like 2
  Uniprot ID: Q9UIR0
  ENST ID: ENST00000549852
  CDS Start-End: 309-845

SEQ ID NO: 112591 - DNA, 845 bp, Homo sapiens; identical to SEQ ID NO: 112588
  Payload ID: 2023
  Gene Symbol: BTNL2
  Gene Name: butyrophilin-like 2
  Uniprot ID: Q9UIR0
  ENST ID: ENST00000553032
  CDS Start-End: 309-845

SEQ ID NO: 112592 - DNA, 845 bp, Homo sapiens; identical to SEQ ID NO: 112588
  Payload ID: 2023
  Gene Symbol: BTNL2
  Gene Name: butyrophilin-like 2
  Uniprot ID: Q9UIR0
  ENST ID: ENST00000550698
  CDS Start-End: 309-845

SEQ ID NO: 112593 - DNA, 738 bp, Homo sapiens
  Payload ID: 2023
  Gene Symbol: BTNL2
  Gene Name: butyrophilin-like 2
  Uniprot ID: Q9UIR0
  ENST ID: ENST00000548253
  CDS Start-End: 1-738
atggtggattttccaggctacaatctgtctggtgcagtcgcctccttcctattcatcctgctgacaatgaagcagtcagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 112594 - DNA, 1368 bp, Homo sapiens; identical to SEQ ID NO: 112564
  Payload ID: 2023
  Gene Symbol: BTNL2
  Gene Name: butyrophilin-like 2
  Uniprot ID: Q9UIR0
  ENST ID: ENST00000550327
  CDS Start-End: 1-1368

SEQ ID NO: 112595 - DNA, 1368 bp, Homo sapiens; identical to SEQ ID NO: 112564
  Payload ID: 2023
  Gene Symbol: BTNL2
  Gene Name: butyrophilin-like 2
  Uniprot ID: Q9UIR0
  ENST ID: ENST00000550531
  CDS Start-End: 1-1368

SEQ ID NO: 112596 - DNA, 1368 bp, Homo sapiens
  Payload ID: 2023
  Gene Symbol: BTNL2
  Gene Name: butyrophilin-like 2
  ENST ID: ENST00000551471
  CDS Start-End: 1-1368
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagatgaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 112597 - DNA, 845 bp, Homo sapiens; identical to SEQ ID NO: 112588
  Payload ID: 2023
  Gene Symbol: BTNL2
  Gene Name: butyrophilin-like 2
  Uniprot ID: Q9UIR0
  ENST ID: ENST00000549560
  CDS Start-End: 309-845

SEQ ID NO: 112598 - DNA, 738 bp, Homo sapiens
  Payload ID: 2023
  Gene Symbol: BTNL2
  Gene Name: butyrophilin-like 2
  Uniprot ID: Q9UIR0
  ENST ID: ENST00000548832
  CDS Start-End: 1-738
atggtggattttccaggctacaatctgtctggtgcagtcgcctccttcctattcatcctgctgacaatgaagcagtcagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 112599 - DNA, 1368 bp, Homo sapiens; identical to SEQ ID NO: 112596
  Payload ID: 2023
  Gene Symbol: BTNL2
  Gene Name: butyrophilin-like 2
  ENST ID: ENST00000551409
  CDS Start-End: 1-1368

SEQ ID NO: 112600 - DNA, 1368 bp, Homo sapiens; identical to SEQ ID NO: 112596
  Payload ID: 2023
  Gene Symbol: BTNL2
  Gene Name: butyrophilin-like 2
  ENST ID: ENST00000548835
  CDS Start-End: 1-1368

SEQ ID NO: 112601 - DNA, 845 bp, Homo sapiens; identical to SEQ ID NO: 112589
  Payload ID: 2023
  Gene Symbol: BTNL2
  Gene Name: butyrophilin-like 2
  Uniprot ID: Q9UIR0
  ENST ID: ENST00000548717
  CDS Start-End: 309-845

SEQ ID NO: 112602 - DNA, 1368 bp, Homo sapiens; identical to SEQ ID NO: 112564
  Payload ID: 2023
  Gene Symbol: BTNL2
  Gene Name: butyrophilin-like 2
  Uniprot ID: Q9UIR0
  ENST ID: ENST00000552479
  CDS Start-End: 1-1368

SEQ ID NO: 112603 - DNA, 1368 bp, Homo sapiens; identical to SEQ ID NO: 112564
  Payload ID: 2023
  Gene Symbol: BTNL2
  Gene Name: butyrophilin-like 2
  Uniprot ID: Q9UIR0
  ENST ID: ENST00000551095
  CDS Start-End: 1-1368

SEQ ID NO: 112604 - DNA, 845 bp, Homo sapiens; identical to SEQ ID NO: 112588
  Payload ID: 2023
  Gene Symbol: BTNL2
  Gene Name: butyrophilin-like 2
  Uniprot ID: Q9UIR0
  ENST ID: ENST00000549943
  CDS Start-End: 309-845

SEQ ID NO: 112605 - DNA, 738 bp, Homo sapiens; identical to SEQ ID NO: 112593
  Payload ID: 2023
  Gene Symbol: BTNL2
  Gene Name: butyrophilin-like 2
  Uniprot ID: Q9UIR0
  ENST ID: ENST00000551686
  CDS Start-End: 1-738

SEQ ID NO: 112606 - DNA, 845 bp, Homo sapiens
  Payload ID: 2023
  Gene Symbol: BTNL2
  Gene Name: butyrophilin-like 2
  ENST ID: ENST00000618142
  CDS Start-End: 309-845
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaggaggccagtttggatctgaaggtggtaggtctgggttcttccccactgatcactgtggaggggcaagaagatggagaaatgcagctgatatgctcttcagatgggtggttcccacagccccacgtgcagtggagggacatggaaggaaagacgataccatcctcttcccaggccctgactcaaggcagccatgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 112607 - DNA, 1368 bp, Homo sapiens
  Payload ID: 2023
  Gene Symbol: BTNL2
  Gene Name: butyrophilin-like 2
  ENST ID: ENST00000613156
  CDS Start-End: 1-1368
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagataaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaggaggccagtttggatctgaaggtggtaggtctgggttcttccccactgatcactgtggaggggcaagaagatggagaaatgcagctgatatgctcttcagatgggtggttcccacagccccacgtgcagtggagggacatggaaggaaagacgataccatcctcttcccaggccctgactcaaggcagccatgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 112608 - DNA, 2440 bp, Homo sapiens
  Payload ID: 2024
  Gene Symbol: BTNL3
  Gene Name: butyrophilin-like 3
  Uniprot ID: Q6UXE8
  ENST ID: ENST00000342868
  CDS Start-End: 185-1585
catactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggagagacgtttttccagccctcaccttggcgcctggcttctattttactcgggttactctgtggtgccctgtgtggtgttgtcatggggatgataattgttttcttcaaatccaaagggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccata

SEQ ID NO: 112609 - DNA, 2229 bp, Homo sapiens
  Payload ID: 2025
  Gene Symbol: BTNL8
  Gene Name: butyrophilin-like 8
  Uniprot ID: Q6UX41
  ENST ID: ENST00000231229
  CDS Start-End: 235-1278
tagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaaggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaa

SEQ ID NO: 112610 - DNA, 2071 bp, Homo sapiens
  Payload ID: 2025
  Gene Symbol: BTNL8
  Gene Name: butyrophilin-like 8
  Uniprot ID: Q6UX41
  ENST ID: ENST00000340184
  CDS Start-End: 207-1709
agagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaa

SEQ ID NO: 112611 - DNA, 1512 bp, Homo sapiens
  Payload ID: 2025
  Gene Symbol: BTNL8
  Gene Name: butyrophilin-like 8
  Uniprot ID: Q6UX41
  ENST ID: ENST00000400707
  CDS Start-End: 268-1395
ggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtgctcctcaagatcgaatgaagtaactgatgtggacatggtttgtcaaatcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacat

SEQ ID NO: 112612 - DNA, 700 bp, Homo sapiens
  Payload ID: 2025
  Gene Symbol: BTNL8
  Gene Name: butyrophilin-like 8
  ENST ID: ENST00000503543
  CDS Start-End: 6-131
gagacatgcatggcctgtttgatgtggagatctctctgaccgtccaagagaacgccgggagcatatcctgttccatgcggcatgctcatctgagccgagaggtggaatccagggtacagataggagtgtaagcgagagagagaagcatgggccggtgccttattcatggttccagcagggacaggatcagagatgctcccacatccagctgcttctcttcttctagtcctagcctccaggggcccaggcccaaaaaaggaaaatccaggcggaactggactggagaagaaagcacggacaggcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaat

SEQ ID NO: 112613 - DNA, 1717 bp, Homo sapiens
  Payload ID: 2025
  Gene Symbol: BTNL8
  Gene Name: butyrophilin-like 8
  Uniprot ID: Q6UX41
  ENST ID: ENST00000508408
  CDS Start-End: 38-1060
gtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaaactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcag

SEQ ID NO: 112614 - DNA, 1260 bp, Homo sapiens
  Payload ID: 2025
  Gene Symbol: BTNL8
  Gene Name: butyrophilin-like 8
  Uniprot ID: Q6UX41
  ENST ID: ENST00000511704
  CDS Start-End: 38-1192
gtttccatgccgtgaggtccattcacagaacacatccatggctctcatgctcagtttggttctgagtctcctcaagctgggatcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcag

SEQ ID NO: 112615 - DNA, 1294 bp, Homo sapiens
  Payload ID: 2025
  Gene Symbol: BTNL8
  Gene Name: butyrophilin-like 8
  ENST ID: ENST00000505126
  CDS Start-End: 359-1240
agtcacacccttcacagtgaaatgtatttgacggggctgggtgcagtggctcaagcccgtaatcccaacaccttgagaggctgagacaggaggattgcttgagtccaggagctcgagaccagcctgggcatatgcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagat

SEQ ID NO: 112616 - DNA, 1600 bp, Homo sapiens
  Payload ID: 2025
  Gene Symbol: BTNL8
  Gene Name: butyrophilin-like 8
  Uniprot ID: Q6UX41
  ENST ID: ENST00000533815
  CDS Start-End: 290-1240
agtcacacccttcacagtgaaatgtatttgacggggctgggtgcagtggctcaagcccgtaatcccaacaccttgagaggctgagacaggaggattgcttgagtccaggagctcgagaccagcctgggcatatgcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagt

SEQ ID NO: 112617 - DNA, 1488 bp, Homo sapiens
  Payload ID: 2025
  Gene Symbol: BTNL8
  Gene Name: butyrophilin-like 8
  Uniprot ID: Q6UX41
  ENST ID: ENST00000610640
  CDS Start-End: 1-1128
atgtggacatggtttgtcaaatcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagt

SEQ ID NO: 112618 - DNA, 3500 bp, Homo sapiens
  Payload ID: 2026
  Gene Symbol: BTNL9
  Gene Name: butyrophilin-like 9
  Uniprot ID: Q6UXG8
  ENST ID: ENST00000327705
  CDS Start-End: 232-1839
agagcaaacggcatatatcttagggtggaagatggataaataattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccaggtggcccccactgctgacgagagatggtggacctctcagtctccccagactccttgaagccagtatcgctgaccagcagtcttgtcttcctcatgcacctcctcctccttcagcctggggagccgagctcagaggtcaaggtgctaggccctgagtatcccatcctggccctcgtcggggaggaggtggagttcccgtgccacctatggccacagctggatgcccagcaaatggagatccgctggttccggagtcagaccttcaatgtggtacacctgtaccaggagcagcaggagctccctggcaggcagatgccggcgttccggaacaggaccaagttggtcaaggacgacatcgcctatggcagcgtggtcctgcagcttcacagcatcatcccctctgacaagggcacatatggctgccgcttccactccgacaacttctctggcgaagctctctgggaactggaggtagcagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcagacgtgttcgtacccggagcctctgcgtggaagagcgcgttcgtcgcgaccctgccgctgctgttggtcctcgcggcgctggcgctgggcgtcctccggaagcagcggagaagccgagaaaagctgaggaagcaggcggagaagagacaagagaaactcactgcagagctggaaaagcttcagacagagcttgactggagacgggctgaaggccaggctgagtggagagcagcccaaaaatatgcagtggatgtgacgctggacccggcctcggcgcaccccagcctggaggtgtcggaggatggcaagagcgtgtcttcccgcggggcgccgccaggcccggcgcctggccacccgcagcggttctcggagcagacgtgcgcgctgagcctggagcggttctccgccggccgccactactgggaggtgcacgtgggccgccgcagccgctggttcctgggcgcctgcctggccgcggtgccgcgcgcggggcctgcgcgcctgagccctgcggccggctactgggtgctggggctgtggaacggctgcgagtacttcgtcctggccccgcaccgcgtcgcgctcaccctgcgcgtgcccccgcggcgcctgggcgtcttcctggactacgaggccggagagctgtccttcttcaacgtgtccgacggctcccacatcttcaccttccacgacaccttctcgggcgcgctctgtgcgtacttcaggcccagggcccacgacggcggcgaacatccggatcccctgaccatctgcccgctgccggttagagggacgggcgtccccgaagagaacgacagtgacacctggctacagccctatgagcccgcggaccccgccctggactggtggtgaggcgccctcgtggccgcgggactggccccggggggccccctggatcccaggccagcgctttgctctcctgctccgtctgaagggagcaggtgcaccagccaaaatgtcagcgagggggacaaagagagggacctttgcctacgtagatgtgtatgtgtagtgcgattttcttcaaggaaaggagacaagtccaaagctcgtttgtggattgtgggactgagcgaaggagtacaaatatatccacgtcgctcagagctggggtgctcacggtgggcggtgggcaagaagccagcatggaagaaagaagggagaaaactttggtgactgccttagagggatcagttaatttgtatagttttatattttttgtatatgtttgctagctctaaaaaggtcgagatgcaataacacttcgtaagcaacgagttcacctaagtaaggctcagatcctagttttaaaaaccatttcccattaaaatgaagttggaggaacagctgcttctggagccggggcaaaaatttcaaggtgagcctggagcattgtgtgtggtgaagtaaaataaaggctcaaaacgtgacggcaacccggcaaaagggtagggagccaggccgaaggggcctcactgaccaattgtgggacaatttgaacatcaggatgaataatgacaggagagattataacacactgaataaaaacataatccatgagttcatgctgatactcaaatttctttttaaaaaggagaaacaggaaggtttcttttggaggtgaaatctaattattggtgagagtcttggagaacaggctgtttccagtctcaaagcagtaaccttatacactacttataagtttgaaaggggaaaggttacctttacaatggagacatctaccagatcatccaagtgattaaatttaacatcatcaatgatgggaccaaggacattattagtttgacaactggggaaagaagtgttcttcaccccctacccccaagacattgtctctgtcggccaggctggagtgcagcctcaacctcctgggtccaagtgatcctcccacctcagcacacaacaccatgcccaattttaagtgcgttatagagacgggggtctcactttgttacccaggctggtctcaaactcctgcgctcaagcaatcctcccacctgggcctcccaaaatgctgggtgtacaggcatgagccgctgtgcctggcttcattttcagagtgagacatttgtactgtggctatgtaggagaacattcttgttcttagcaaacatactgaagtttttagatattaattaccacagtgtctgccactgaatttccagtgactaagtggaaaaatataaaacatatgaatataaagaaagaaagagacaagtcaaatgtagtaaaatgacaacacttggtgactctaggtgactggtcgacagatgttcattgtactatcaatgtggctttgctgtgggtttgaaattttgcaaactaagagttgggtggcggggagaaggatacaccaaaaaactaagtgattatctttggatgggaaaatgtttggtaattgcattcttaaaatgtcttctttgtattttttaatgttcaataatgtatatgtatcagttctgtaataaaggggaaaacactttttttaaata

SEQ ID NO: 112619 - DNA, 1626 bp, Homo sapiens
  Payload ID: 2026
  Gene Symbol: BTNL9
  Gene Name: butyrophilin-like 9
  Uniprot ID: Q6UXG8
  ENST ID: ENST00000376841
  CDS Start-End: 232-1266
agagcaaacggcatatatcttagggtggaagatggataaataattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccaggtggcccccactgctgacgagagatggtggacctctcagtctccccagactccttgaagccagtatcgctgaccagcagtcttgtcttcctcatgcacctcctcctccttcagcctggggagccgagctcagaggtcaaggtgctaggccctgagtatcccatcctggccctcgtcggggaggaggtggagttcccgtgccacctatggccacagctggatgcccagcaaatggagatccgctggttccggagtcagaccttcaatgtggtacacctgtaccaggagcagcaggagctccctggcaggcagatgccggcgttccggaacaggaccaagttggtcaaggacgacatcgcctatggcagcgtggtcctgcagcttcacagcatcatcccctctgacaagggcacatatggctgccgcttccactccgacaacttctctggcgaagctctctgggaactggaggtagcagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcagacgtgttcgtacccggagcctctgcgtggaagagcgcgttcgtcgcgaccctgccgctgctgttggtcctcgcggcgctggcgctgggcgtcctccggaagcagcggagaagccgagaaaagctgaggaagcaggcggagaagagacaagagaaactcactgcagagctggaaaagcttcagacagagcttgactggagacgggctgaaggccaggctgagtgcttcgttttagccagccaccctcctggagaaggtatccaggctgcctctaactccacaacaacactgaatgcatagtctcaaacgtgttgccttacggcgctgtgtggagatttctctggggtttgcaacctctgaatgctgagaagattgagcatctctgtatatgctagttggctctggggacttcctctactgaaaattgccagctcacatcactgacccatttttcttatgggatggctgtcttttattattaacaggaatattatatatctgtgtgtgtgtgtgtgtgtgtgtgtgtgtgtgtgtgagattaatccctcatgggtaaacatcgtgaattccttcttctgttgtgccatctgccattagctttgtccatagttccccttattgaaaaggaattattaattttgataaaacataatccatcaa

SEQ ID NO: 112620 - DNA, 2199 bp, Homo sapiens
  Payload ID: 2026
  Gene Symbol: BTNL9
  Gene Name: butyrophilin-like 9
  Uniprot ID: Q6UXG8
  ENST ID: ENST00000491209
  CDS Start-End: 220-1167
atatatcttagggtggaagatggataaataattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccaggtggcccccactgctgacgagagatggtggacctctcagtctccccagactccttgaagccagtatcgctgaccagcagtcttgtcttcctcatgcacctcctcctccttcagcctggggagccgagctcagaggtcaaggtgctaggccctgagtatcccatcctggccctcgtcggggaggaggtggagttcccgtgccacctatggccacagctggatgcccagcaaatggagatccgctggttccggagtcagaccttcaatgtggtacacctgtaccaggagcagcaggagctccctggcaggcagatgccggcgttccggaacaggaccaagttggtcaaggacgacatcgcctatggcagcgtggtcctgcagcttcacagcatcatcccctctgacaagggcacatatggctgccgcttccactccgacaacttctctggcgaagctctctgggaactggaggtagcagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcagacgtgttcgtacccggagcctctgcgtggaagagcgcgttcgtcgcgaccctgccgctgctgttggtcctcgcggcgctggcgctgggcgtcctccggaagcagcggagaagccgagaaaagctgaggaagcaggcggagaagagacaaggtgagcggggacagggcgttctgcacgcacctgcccaagtgccaaaacccgccgtcatctaaaggctgtgggtcccgttacgagggtttattccagcgcgaggtgtcagggcggccaccggggaacggggatcggtgaccccggtggggaagggggaagatcgttcatatggacaaaagcggaggtgcggaacggctgcattttccacggaggctagtgcacagatgtcagggttgaccggctgctgtcgttacgccctcggagcttcacatcacactgtacagagggagcggtgaccagggtctctgctgccagcgccacctcgtccaggttttcatagcgcacagggagtcgggcggatgcgcaacatctccgcacagggtcaggaagcggcggtcaggcaccgagaaaacagcccagttacgtgaggcagtgtccggggcttaacgtttccgccgagctaatagatttgggaggctccgaccctgattttcacactagcaggagggagggcgctgggtcaccctcctatgcagaagggcagccaagggtgcgcacttccccatcccctgcctggagcctcacttccagcccagcctgggcccgcagaccaccgcgggtgggagtgccgcatcggaggtgaggcctcagtgttcacccatctgttctgtctgcctcattccccaacctgagagtctttccccttttcttcatcttttttttttttttttctctagagaaactcactgcagagctggaaaagcttcagacagagcttggtaagtgacccctcttagaactatttctcctcagggccgggtccagtggctcacacctgtaatcccagtactttgggaggccgaggcgggtggatcacgaggtcaggagatcgagaccagcctggctaacacagtgaaaccccgtctcttctaaaaatacaaaaaattagcccggcgtggcggcatgtgcctgtagtcccagctacatgggaggctgaggcaggagaagggcgtgaacccgggaagcggagcttgcagtgagccgagatggcgccactgcactccagcctgggcgacagagcgagactctgtctc

SEQ ID NO: 112621 - DNA, 1444 bp, Homo sapiens
  Payload ID: 2026
  Gene Symbol: BTNL9
  Gene Name: butyrophilin-like 9
  ENST ID: ENST00000515271
  CDS Start-End: 266-1006
aattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccagaggtcaaggtgctaggccctgagtatcccatcctggccctcgtcggggaggaggtggagttcccgtgccacctatggccacagctggatgcccagcaaatggagatccgctggttccggagtcagaccttcaatgtggtacacctgtaccaggagcagcaggagctccctggcaggcagatgccggcgttccggaacaggaccaagttggtcaaggacgacatcgcctatggcagcgtggtcctgcagcttcacagcatcatcccctctgacaagggcacatatggctgccgcttccactccgacaacttctctggcgaagctctctgggaactggaggtagcagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcagacgtgttcgtacccggagcctctgcgtggaagagcgcgttcgtcgcgaccctgccgctgctgttggtcctcgcggcgctggcgctgggcgtcctccggaagcagcggagaagccgagaaaagctgaggaagcaggcggagaagagacaaggtgagcggggacagggcgttctgcacgcacctgcccaagtgccaaaacccgccgtcatctaaaggctgtgggtcccgttacgagggtttattccagcgcgaggtgtcagggcggccaccggggaacggggatcggtgaccccggtggggaagggggaagatcgttcatatggacaaaagcggaggtgcggaacggctgcattttccacggaggctagtgcacagatgtcagggttgaccggctgctgtcgttacgccctcggagcttcacatcacactgtacagagggagcggtgaccagggtctctgctgccagcgccacctcgtccaggttttcatagcgcacagggagtcgggcggatgcgcaacatctccgcacagggtcaggaagcggcggtcaggcaccgagaaaacagcccagttacgtgaggcagtgtccggggcttaacgtttccgccgagctaatagatttgggaggctccgaccctgattttcacacta

SEQ ID NO: 112622 - DNA, 2454 bp, Homo sapiens
  Payload ID: 2027
  Gene Symbol: BCHE
  Gene Name: butyrylcholinesterase
  Uniprot ID: P06276
  ENST ID: ENST00000264381
  CDS Start-End: 168-1976
gagctttgtcagtaacagttgattgttacattcagtaacactgaatgtcagtgcagtccaatttacaggctggagcagcagctgcatcctgcatttccccgaagtattacatgattttcactccttgcaaactttgccatctttgttgcagagaatcggaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatca

SEQ ID NO: 112623 - DNA, 702 bp, Homo sapiens
  Payload ID: 2027
  Gene Symbol: BCHE
  Gene Name: butyrylcholinesterase
  ENST ID: ENST00000479451
  CDS Start-End: 1-399
gcagtccaatttacaggctggagcagcagctgcatcctgcatttccccgaagtattacatgattttcactccttgcaaactttgccatctttgttgcagagaatcgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccccaaaa

SEQ ID NO: 112624 - DNA, 739 bp, Homo sapiens
  Payload ID: 2027
  Gene Symbol: BCHE
  Gene Name: butyrylcholinesterase
  ENST ID: ENST00000488954
  CDS Start-End: 1-363
gcagtccaatttacaggctggagcagcagctgcatcctgcatttccccgaagtattacatgattttcactccttgcaaactttgccatctttgttgcagagaatcgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacagagcctatatgctgctactgtgagccaggaactgcactagcagctagagctgcacagatgaaaatgacagggtctgcttactcacagtgaagtggagtcagggcccaggaccatggaaagcttttaagaagagaagatacctgcactgaatctcaatgtgaaggcaaagtggagagaagccagataagcaggaaccagagatgaagtgtcttgtgcatcatgctaaagaatttaaattatattctgagtaaagccatttagtaattttaaatgagaaactgatatgttctggttattgattcataaatgtataatcttttactatattcacgagttattcttttttacctttgtcttcttagagtctagattgtaagaatattatatggcatcaacataataatttcatttctgaggtagggtctttcttccaaatagctgcttttgtttgctggttcattcgcat

SEQ ID NO: 112625 - DNA, 2522 bp, Homo sapiens
  Payload ID: 2027
  Gene Symbol: BCHE
  Gene Name: butyrylcholinesterase
  ENST ID: ENST00000497011
  CDS Start-End: 158-1846
agtaacagttgattgttacattcagtaacactgaatgtcagtgcagtccaatttacaggctggagcagcagctgcatcctgcatttccccgaagtattacatgattttcactccttgcaaactttgccatctttgttgcagagaatcggaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggctgaggagtaggaggaggggaaaaggagctgttggtctcgctgtctctggattgacagaggtggaagaaaatccacatgaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatc

SEQ ID NO: 112626 - DNA, 2527 bp, Homo sapiens
  Payload ID: 2027
  Gene Symbol: BCHE
  Gene Name: butyrylcholinesterase
  ENST ID: ENST00000482958
  CDS Start-End: 158-1735
agtaacagttgattgttacattcagtaacactgaatgtcagtgcagtccaatttacaggctggagcagcagctgcatcctgcatttccccgaagtattacatgattttcactccttgcaaactttgccatctttgttgcagagaatcggaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatggctgttcttcctcaaccatactaaactacgttcttgaaacagaacctgtggttttgatttgatattcattgaagtactatgatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatc

SEQ ID NO: 112627 - DNA, 2237 bp, Homo sapiens
  Payload ID: 2028
  Gene Symbol:
  Gene Name: BX004987.4
  ENST ID: ENST00000618686
  CDS Start-End: 69-296
cctcatcactgtcaccttagagcattagagcctctataggtgctccccaatctctgccctccccacccatggtggtactggggatgcagacagaggaggggcactgcataatgctgagagggctggcacactctctaggtggaacacaggtcatttgtaaagttgtaggtctgccaagcagtattggattcaacacatcttctcaccttctctttccagcgaccctccagggtgccccgactcactttccctgcagatggaggcaaggaggctccacagacaacctccctgcctgaggtcagatagtggccagcaggccaggtactgacaaactgcccctgaccaggttcccagtgatgagtgatgagacccctaatgaccactcctccattgaccaagtcccactgatcaagtccccactgaccatgtcttcctaaccaggcccacacttaataggcctcatgggccagaccccactgaccaattttccactgacctggtccccattgacaagacagggttcccactgacaagaccacaatttaccaggttgctgctcaaccgaccccccactgaacaattctccatgaacgagtacccagctgactgagccccctctgaccaggccctcactgaccaggccccaagccactaaggccccacactgaccaggcccgtgatatattgtgtatgccccaccaaccagtttttcattgtttatgttccaacagatcaggccccagtaataaagccaccactgactaggtccccccactgaccaggcttccaatgactaggtcaccaggtccccactgaggaggctgccactaaccaggcccctgctgatcaggtcccaaatgaccaggtcctgatgaccaggtcatctctgaccatggtccactgaccaggccccagagcaacggggttcaaagtctcattacaatgtccccctcagctcatagaccctccctccctgcatgtgtgcccggaggtcaggccctgggttttttttttgggacgtggcctttcctccaagacacagggagagacagttggcctcaggctccaagttcccagctccacactcaccccaaaggccctctgggcccgtctcaaaggagaaagtgaggtggcctgacactgcctggacacaccatctaccctattcctgagtgtcagagtgtgaggaagggagggacatttggcagataaggcacgctgtgctgttgggtctctcagggcccttcccacagagccccgatctaaagacacaacacagaggctacaggaagactaatccagaacctctgagacagccagggaccacatgagtactctccccagacagccagaagtccctttgctagtttcttggtacttcagtggatgtggcagtggttcttctgttggggaccagtgagtacacactggggagggctcacctgtgtttcctcagtggctccacctctgcttctaaaaaaaatgactcattccagagctggtgcagagaaaatacaagctgagcttagaacatcttctgaaagaaagtaaaaaagtgccgacagagtaatggagacaaatcaaagagacataaagtcagcttggaatgtctactactggcctaatcttggggaattggagcatcagaatcatgagctttctttctcccttatttattggttttatttctccatgtagaacaaagaagagaataagaaaataatcatctggtaaccatcatagtaataattgttcaaacacaagtcatccatgaaatgctaaatctagtgggttctgaggagtaaccagatatttacagagcctcaaagtatctccatacaaaatacggttgaactacaaaaagaaaattgtaacattagcatggacaaacctggcaggtactccttaactctcctaagtaataaaaactgtaaaatgcaaataagccttcgatgacatttactaacctttactaaagtatcaatgatgacttggttgtttaaacagctgaaatttgggcaatttgagtatgtcaaactcaataatactggttttcatttgcaagatccacttaaaacttaaggaggccaaaaaacatcatttaaaatatcctataaattataatcatacatatgatacaaaaatatcctacttcagtaaatattggaatgttatatattttatgagaaacaattaaaatgtgtaaatagcccagtaataaagttttataatctttt

SEQ ID NO: 112628 - DNA, 414 bp, Homo sapiens; identical to SEQ ID NO: 106200
  Payload ID: 2029
  Gene Symbol:
  Gene Name: BX248413.1
  ENST ID: ENST00000611283
  CDS Start-End: 1-414

SEQ ID NO: 112629 - DNA, 2029 bp, Homo sapiens
  Payload ID: 2030
  Gene Symbol: BYSL
  Gene Name: bystin-like
  Uniprot ID: Q13895
  ENST ID: ENST00000230340
  CDS Start-End: 376-1689
tctcggcacccctcggtgacgcctccactgacatcatctgcggattcccgccccgaggtttctaaatccagacattcccgtttggctgagcactctaggcctacatccatgaagctaggagagcgacactcaaagactgcactattgagagaagctaacgttaaaggcagtgaatatattcgggagtccagctccggaacccgggagctcttttagtgggaggggcggcgctgatggcgcttctggcctccgaatgctagggggcgctgtgatcgccgggcggcctcttgggcgctgggagtccaccgcgcaagcgcatcctggcctttcttcagtccccacgtgcgatccttcccggcaactttttcgagaaaaatgcccaaattcaaggcggcccgtggggtggggggtcaggaaaaacatgcgcccctggccgatcagatcctggctgggaatgcggtgcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattgaa

SEQ ID NO: 112630 - DNA, 1299 bp, Homo sapiens
  Payload ID: 2030
  Gene Symbol: BYSL
  Gene Name: bystin-like
  ENST ID: ENST00000372996
  CDS Start-End: 1-550
ggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagtggctgccctttgactctccctagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatgg

SEQ ID NO: 112631 - DNA, 1153 bp, Homo sapiens
  Payload ID: 2030
  Gene Symbol: BYSL
  Gene Name: bystin-like
  ENST ID: ENST00000489290
  CDS Start-End: 30-614
gatccttcccggcaactttttcgagaaaaatgcccaaattcaaggcggcccgtggggtggggggtcaggaaaaacatgcgcccctggccgatcagatcctggctgggaatgcggtgcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagctt

SEQ ID NO: 112632 - DNA, 2439 bp, Homo sapiens
  Payload ID: 2031
  Gene Symbol: C15orf38-AP3S2
  Gene Name: C15orf38-AP3S2 readthrough
  ENST ID: ENST00000398333
  CDS Start-End: 48-1232
agcccagtgcgccggctctgtgccggggtgcccgggcggtcgggagaatgagccgcatctaccacgacggcgcgctccggaacaaggcggtgcagagcgtccggctgccaggggcctgggaccccgccgcccaccaggggggaaatggtgtcctgctggagggagaactgatcgatgtatctcggcacagcatcttggacactcatggcaggaaggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtggccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgaga

SEQ ID NO: 112633 - DNA, 664 bp, Homo sapiens
  Payload ID: 2031
  Gene Symbol: C15orf38-AP3S2
  Gene Name: C15orf38-AP3S2 readthrough
  ENST ID: ENST00000558648
  CDS Start-End: 108-664
tgctgtatatccggcccagtcacatccatcgccgtaaattcgacgccaagggaaatgaaatcgagcccaacttcagcgccaccaggaaggtgaacacgggcttcctcatgtcgtcctacaaggtggaagccaagggggacactgacaggctcacgcccgaggcgctgaaggggctggtcaacaagccagagctgctcgcgctgacagagagcctcacccccgaccacacagtggcgttctggatgcccgagtcagagatggaggtgatggaactcgagctgggggccggggtacggctgaagactcggggcgatggtcccttcctggattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtgggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaa

SEQ ID NO: 112634 - DNA, 675 bp, Homo sapiens
  Payload ID: 2031
  Gene Symbol: C15orf38-AP3S2
  Gene Name: C15orf38-AP3S2 readthrough
  ENST ID: ENST00000559629
  CDS Start-End: 122-675
ggagcgctactacgtgctgtatatccggcccagtcacatccatcgccgtaaattcgacgccaagggaaatgaaatcgagcccaacttcagcgccaccaggaaggtgaacacgggcttcctcatgtcgtcctacaattcattggccaaacttgaggctggaacagtgaccaagtgtaatttcactggtgatggaaagacaggggcatcctggacagacaacatcatggcccaaaagtgttcgaagggggctgcagcggagatccgagagcagggggatggggcagaggacgaggagtggccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaa

SEQ ID NO: 112635 - DNA, 2233 bp, Homo sapiens
  Payload ID: 2032
  Gene Symbol: C1D
  Gene Name: C1D nuclear receptor corepressor
  Uniprot ID: Q13901
  ENST ID: ENST00000355848
  CDS Start-End: 49-474
gggagactggagtcgaaggccgtgaggtatttttctaagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatcttcccccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataactgacctgtgtatttttatcttttgagtaaatttgccttccaaattaggaagataggttttagaagtcatcacaaatagagaaattcttgagtttttgttcctgatgcatggtgtccacagttcttttcatctcattttttttcagattttttttatttcatgtttttgaggctgtatcaagtacatacaagtgttttggaacaacttcttaagttacctaatgccacttaagcagatgagaagtccaaaggagattacactgtgtttgtattgtggtttatttttctggaatattagttacagagagtactacatagtaaacctttttttaaatgtctaagcccatgaattttaattatatgcccttaatgctttcagtgtttgaatccatatcattatgtgtaggaatgccaagtatagtaaagtactttaatttttgaaaaaggagttgttaaaattttctgtgtgattaattctccataagtaaccttgaataaatggatttcttgatttatgatagcagatattggaaatggtcttaaaatgtaatggattttgtaaagcatgttgaactctttctatgacacatgaagaggaagtcactgatagacgcagaaggtcttttctgtctctgatgtcagtttttgaagtggaagaacattagtgaacatttatagttattttactcctttttttgcctttgtctccaaatttctagctatttttaaaaataacctcttcatgagagaaatgtgttactgttaagatcaagtgtagtgtacctgtctttgtgttatttattgcaaagaaatttatttggatttctgtatattttctaatttcataaaagaaaaacagcttaaatgaaaaatgttatacaattgcagaaaatcattattggttttagctaagttattggtttatgaaagtgcacctctacgttctgttaaattgtgtaacttttaagtgagtaattctttcattattaggtagaaataaaagtttgagtatattccattttattatgtataattttaaatacttagcacgtaataaggagctgaatggctgta

SEQ ID NO: 112636 - DNA, 1379 bp, Homo sapiens
  Payload ID: 2032
  Gene Symbol: C1D
  Gene Name: C1D nuclear receptor corepressor
  ENST ID: ENST00000407324
  CDS Start-End: 157-699
ggagactggagtcgaaggccgtgaggtatttttctaagtgagaggaaggactgagtggcagtaacatctgttagggttactgggcagcatccccgcaacccaggtactcagtctcagccacaccttactgagtggtgaagagaagcaagttttctcatgccctctccgtctgtctctacctctgcagccagtgttttagaaggagtatgtggaagggcaaggagtacctatagaaccccggaggagggtgaggagcagagctggtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatcttcccccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttg

SEQ ID NO: 112637 - DNA, 736 bp, Homo sapiens
  Payload ID: 2032
  Gene Symbol: C1D
  Gene Name: C1D nuclear receptor corepressor
  Uniprot ID: Q13901
  ENST ID: ENST00000410067
  CDS Start-End: 78-503
agccggcgcgtcattgtcgtcatcgttgcccgaccgctttccgggagactggagtcgaaggccgtgagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatcttcccccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctctt

SEQ ID NO: 112638 - DNA, 772 bp, Homo sapiens
  Payload ID: 2032
  Gene Symbol: C1D
  Gene Name: C1D nuclear receptor corepressor
  Uniprot ID: Q13901
  ENST ID: ENST00000409302
  CDS Start-End: 135-560
tcgtcatcgttgcccgaccgctttccgggagactggagtcgaaggccgtgagccagtgttttagaaggagtatgtggaagggcaaggagtacctatagaaccccggaggagggtgaggagcagagctggccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatcttcccccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatat

SEQ ID NO: 112639 - DNA, 1613 bp, Homo sapiens
  Payload ID: 2033
  Gene Symbol: C1GALT1C1
  Gene Name: C1GALT1-specific chaperone 1
  Uniprot ID: Q96EU7
  ENST ID: ENST00000304661
  CDS Start-End: 240-1196
cgcgggcgggcaaacggacggctccgcccagccgccggctcctttaccccgccccactacccccgccttcgcggcgctcgtttcctggcgctccccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaaattatgaacattagaaatctgtggggcacatatttttgctgattggttaaaaaattttaacaggtctttagcgttctaagatatgcaaatgatatctctagttgtgaatttgtgattaaagtaaaacttttagctgtg

SEQ ID NO: 112640 - DNA, 1492 bp, Homo sapiens
  Payload ID: 2033
  Gene Symbol: C1GALT1C1
  Gene Name: C1GALT1-specific chaperone 1
  Uniprot ID: Q96EU7
  ENST ID: ENST00000371313
  CDS Start-End: 257-1213
gtaacggagtggtgcgccaacgtgagaggaaacccgtgcgcggctgcgctttcctgtccccaagccgttctagacgcggatgaagtgcaaaacaaacttctccatagaggagttgttgcaaagttccagtttataccaaacagtaatcagattccattggaagctaaagattttgagagccttttgtactatatgcaactaacttgatttcaagcttgggaaccttttaaaaaaaacattaaaagcaaaatgaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaa

SEQ ID NO: 112641 - DNA, 1172 bp, Homo sapiens
  Payload ID: 2034
  Gene Symbol: C1GALT1C1L
  Gene Name: C1GALT1-specific chaperone 1 like
  Uniprot ID: P0DN25
  ENST ID: ENST00000475092
  CDS Start-End: 1-948
atggtttccgctagtgggacatcattttttaagggtatgttgcttgggagcatttcctgggttttgataactatgtttggccaaattcacattcgacacagaggtcaaactcaagaccacgagcaccatcaccttcgtccacctaacaggaacgatttcttaaacacttcaaaagtgatactcttggagctcagtaaaagtattcgtgttttctgtatcatctttggagaatccgaagatgagagttactgggctgtactgaaagagacctggaccaaacactgtgacaaagcagagctctacgatactaaaaatgataatttgttcaatatagaaagtaatgacaggtgggtacagatgaggaccgcttacaaatacgtctttgaaaagtatggtgacaactacaactggttcttccttgcacttcccactacgtttgctgtcattgaaaatttaaagtaccttttgtttacaagggatgcatcccagcccttctatctgggccacactgttatatttggagacctcgaatacgtgactgtggaaggagggattgtcttaagcagagagttgatgaaaagacttaacagacttctcgataactctgagacctgtgcagatcaaagtgtgatttggaagttatctgaagataagcagctggcaatatgcctgaaatatgcaggagttcatgcagaaaatgcagaggattatgaaggaagagatgtatttaatacaaaaccaatcgcacagcttattgaagaggcattgtctaataaccctcagcaagtagtagaaggctgctgttcagatatggctattactttcaatggactgaccccccaaaagatggaagtaatgatgtatggcctgtaccggctcagggcatttggacactatttcaatgacacactcgttttcttgcctccagttggttcagaaaatgactgaggcctggagaataatagacctgtgctgtccaagagcacttgaaatgtggctagtccaaattctgatacagtgtaagtgtaaaatacgtacttcattcaataattcatatattattagaaaacagtatgaagatgtaaaacatctcagtaatatttcatattgactccacattgaaataatgttttggatattttgcattaaataaaatatactattaaaattaa

SEQ ID NO: 112642 - DNA, 2624 bp, Homo sapiens
  Payload ID: 2035
  Gene Symbol: C1QTNF1
  Gene Name: C1q and tumor necrosis factor related protein 1
  ENST ID: ENST00000311661
  CDS Start-End: 326-925
agagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagc

SEQ ID NO: 112643 - DNA, 3100 bp, Homo sapiens
  Payload ID: 2035
  Gene Symbol: C1QTNF1
  Gene Name: C1q and tumor necrosis factor related protein 1
  Uniprot ID: Q9BXJ1
  ENST ID: ENST00000339142
  CDS Start-End: 556-1401
atctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagcaggggcaagcctgccgcccgaggccttccagctgggaggtgagctgaggacagctgctctactcaaggaaatctttgtttccactgggacggaatcggagctctggaggctgggctggccaagcgccccgaaggcccgatgcctgacggctcatgcggcctccttgtttgcagggcctgggcaaaaatttacactgagtcccactcttcgctccagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagc

SEQ ID NO: 112644 - DNA, 2714 bp, Homo sapiens
  Payload ID: 2035
  Gene Symbol: C1QTNF1
  Gene Name: C1q and tumor necrosis factor related protein 1
  Uniprot ID: Q9BXJ1
  ENST ID: ENST00000354124
  CDS Start-End: 170-1015
atttgtcctcagctctacctgagtgctggcctcgcccagcctggggcaaggcagtgggcattgtgcttgcaccctcttcttcctctcctttttgattcttttcatctgtccagttgttggtgcggcggatgggaggacactccaggcagggaaagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagc

SEQ ID NO: 112645 - DNA, 2833 bp, Homo sapiens
  Payload ID: 2035
  Gene Symbol: C1QTNF1
  Gene Name: C1q and tumor necrosis factor related protein 1
  Uniprot ID: Q9BXJ1
  ENST ID: ENST00000392445
  CDS Start-End: 288-1133
gcacttggctgtggtgtgtgctgcagggagcgggaggacatgggaggacgtgctccaggaggcctctccagcacctgccaaccggggaggagggaaccaagacagggagatgggagccgaggtctgaggacaagcagaagcttccccaccctccctcttagagctgcagagctggagaggcccctagagtccacccaacaacaacagtggcaatcatcatcaccatcatcatcatcatcaccatcatcatcatcatcatgatgtcagccacagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggaggacaaagaaaagggttgttatttttgtctttccagccagcctgctggctcccaagagagaggccttttcagttgagactctgcttaagagaagatccaaagttaaagctctggggtcaggggaggggccgggggcaggaaactacctctggcttaattcttttaagccacgtaggaactttcttgagggataggtggaccctgacatccctgtggccttgcccaagggctctgctggtctttctgagtcacagctgcgaggtgatgggggctggggccccaggcgtcagcctcccagagggacagctgagccccctgccttggctccaggttggtagaagcagccgaagggctcctgacagtggccagggacccctgggtcccccaggcctgcagatgtttctatgaggggcagagctcctggtacatccatgtgtggctctgctccacccctgtgccaccccagagccctggggggtggtctccatgcctgccaccctggcatcggctttctgtgccgcctcccacacaaatcagccccagaaggccccggggccttggcttctgttttttataaaacacctcaagcagcactgcagtctcccatctcctcgtgggctaagcatcaccgcttccacgtgtgttgtgttggttggcagcaaggctgatccagaccccttctgcccccactgccctcatccaggcctctgaccagtagcctgagaggggctttttctaggcttcagagcaggggagagctggaaggggctagaaagctcccgcttgtctgtttctcaggctcctgtgagcctcagtcctgagaccagagtcaagaggaagtacacgtcccaatcacccgtgtcaggattcactctcaggagctgggtggcaggagaggcaatagcccctgtggcaattgcaggaccagctggagcagggttgcggtgtctccacggtgctctcgccctgcccatggccaccccagactctgatctccaggaaccccatagcccctctccacctcaccccatgttgatgcccagggtcactcttgctacccgctgggcccccaaacccccgctgcctctcttccttccccccatcccccacctggttttgactaatcctgcttccctctctgggcctggctgccgggatctggggtccctaagtccctctctttaaagaacttctgcgggtcagactctgaagccgagttgctgtgggcgtgcccggaagcagagcgccacactcgctgcttaagctcccccagctctttccagaaaacattaaactcagaattgtgttttcagca

SEQ ID NO: 112646 - DNA, 1368 bp, Homo sapiens
  Payload ID: 2035
  Gene Symbol: C1QTNF1
  Gene Name: C1q and tumor necrosis factor related protein 1
  Uniprot ID: Q9BXJ1
  ENST ID: ENST00000581774
  CDS Start-End: 364-1209
gttttgggagcggtcggtccccgagggcgtccccgctgctggtgctagggaagtgggcggcgggccaggccacctgcagagtgggctcaggacagctgttggtgcctcttctctctcacacggttctcaaagcaggggcaagcctgccgcccgaggccttccagctgggaggtgagctgaggacagctgctctactcaaggaaatctttgtttccactgggacggaatcggagctctggaggctgggctggccaagcgccccgaaggcccgatgcctgacggctcatgcggcctccttgtttgcagggcctgggcaaaaatttacactgagtcccactcttcgctccagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcc

SEQ ID NO: 112647 - DNA, 1396 bp, Homo sapiens
  Payload ID: 2035
  Gene Symbol: C1QTNF1
  Gene Name: C1q and tumor necrosis factor related protein 1
  Uniprot ID: Q9BXJ1
  ENST ID: ENST00000580454
  CDS Start-End: 392-1237
agcctggggcaaggcagtgggcattgtgcttgcaccctcttcttcctctcctttttgattcttttcatctgtccagttgttggtgcggcggatgggaggacactccaggcagggaaagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcc

SEQ ID NO: 112648 - DNA, 1129 bp, Homo sapiens
  Payload ID: 2035
  Gene Symbol: C1QTNF1
  Gene Name: C1q and tumor necrosis factor related protein 1
  Uniprot ID: Q9BXJ1
  ENST ID: ENST00000583904
  CDS Start-End: 125-970
acactgctgcactccagcctgggtgacagagcaagactccatctcaaaaaaaaaaaaaaaaagcccgctacagacatcccccgcagaggctccaaagcccccgagcgacgggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcc

SEQ ID NO: 112649 - DNA, 1600 bp, Homo sapiens
  Payload ID: 2035
  Gene Symbol: C1QTNF1
  Gene Name: C1q and tumor necrosis factor related protein 1
  Uniprot ID: Q9BXJ1
  ENST ID: ENST00000580474
  CDS Start-End: 377-1222
gtggattgcatgtgtgttgggtgcatgtgaatgtgtgggttgcatgtgagtgtatgtgactgtgtgtgcatgtgtggattgcatgtgtgttgagtgtgtgcatgtgtgggggttgcatgtatgtgaatgtgtgtgcatgtgcgtgtgtgcacgtgagtgcgtcgtgagtgcgtgtatgcatgcatgggtgtgtgagagtgattgtcctcccagaagctgtgtaactgcagcatttcccagtggcgtgaggctggggaagcacctccgatttccaggctgtttctctccccaattttcaggctgtttctctgtgcagctccttcctaactcggtgccttccctgtgtgtttctttcccaccagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaa

SEQ ID NO: 112650 - DNA, 1294 bp, Homo sapiens
  Payload ID: 2035
  Gene Symbol: C1QTNF1
  Gene Name: C1q and tumor necrosis factor related protein 1
  ENST ID: ENST00000578229
  CDS Start-End: 536-1135
ggcctggcagcctttctccctgtactcacaggaggggttgacgcatgcagtcagggcctctgtggagtggcttttgggcgcctcgcctgcccggaagcctccccttctgttctcatctccatttgtcctcagctctacctgagtgctggcctcgcccagcctggggcaaggcagtgggcattgtgcttgcaccctcttcttcctctcctttttgattcttttcatctgtccagttgttggtgcggcggatgggaggacactccaggcagggaaagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcc

SEQ ID NO: 112651 - DNA, 1672 bp, Homo sapiens
  Payload ID: 2035
  Gene Symbol: C1QTNF1
  Gene Name: C1q and tumor necrosis factor related protein 1
  Uniprot ID: Q9BXJ1
  ENST ID: ENST00000579760
  CDS Start-End: 440-1285
ggatttccctgaggcgcggcgcggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctgctctgtttccttcaccgagtctgtgcatcgccccggacctggccgggaggaggcttggccggcgggagatgctctaggggcggcgcgggaggagcggccggcgggacggagggcccggcaggaagatgggctcccgtggacagggactcttgctggcgtactgcctgctccttgcctttgcctctggcctggtcctgagtcgtgtgccccatgtccagggggaacagcaggagtgggaggggactgaggagctgccgtcgcctccggaccatgccgagagggctgaagaacaacatgaaaaatacaggcccagtcaggaccaggggctccctgcttcccggtgcttgcgctgctgtgaccccggtacctccatgtacccggcgaccgccgtgccccagatcaacatcactatcttgaaaggggagaagggtgaccgcggagatcgaggcctccaagggaaatatggcaaaacaggctcagcaggggccaggggccacactggacccaaagggcagaagggctccatgggggcccctggggagcggtgcaagagccactacgccgccttttcggtgggccggaagaagcccatgcacagcaaccactactaccagacggtgatcttcgacacggagttcgtgaacctctacgaccacttcaacatgttcaccggcaagttctactgctacgtgcccggcctctacttcttcagcctcaacgtgcacacctggaaccagaaggagacctacctgcacatcatgaagaacgaggaggaggtggtgatcttgttcgcgcaggtgggcgaccgcagcatcatgcaaagccagagcctgatgctggagctgcgagagcaggaccaggtgtgggtacgcctctacaagggcgaacgtgagaacgccatcttcagcgaggagctggacacctacatcaccttcagtggctacctggtcaagcacgccaccgagccctagctggccggccacctcctttcctctcgccaccttccacccctgcgctgtgctgaccccaccgcctcttccccgatccctggactccgactccctggctttggcattcagtgagacgccctgcacacacagaaagccaaagcgatcggtgctcccagatcccgcagcctctggagagagctgacggcagatgaaatcaccagggcggggcacccgcgagaaccctctgggaccttccgcggccctctctgcacacatcctcaagtgaccccgcacggcgagacgcgggtggcggcagggcgtcccagggtgcggcaccgcggctccagtccttggaaataattaggcaaattctaaaggtctcaaaaggagcaaagtaaaccgtggagg

SEQ ID NO: 112652 - DNA, 2414 bp, Homo sapiens
  Payload ID: 2036
  Gene Symbol: C1QTNF2
  Gene Name: C1q and tumor necrosis factor related protein 2
  Uniprot ID: Q9BXJ5
  ENST ID: ENST00000393975
  CDS Start-End: 5-997
cgggatgggaaaactatgcctggggccgacgctctgcccggctgctgccgctgaggaaagccgggacgcggagccccgccgagagcttctttgctccggacgcccctggacgtggcgggcagccgcgagggtaaccaccatgatcccctgggtgctcctggcctgtgccctcccctgtgctgctgacccactgcttggcgcctttgctcgcagggacttccggaaaggctcccctcaactggtctgcagcctgcctggcccccagggcccacccggccccccaggagccccagggccctcaggaatgatgggacgaatgggctttcctggcaaagacggccaagatggacacgacggcgaccggggggacagcggagaggaaggtccacctggccggacaggtaaccggggaaagccaggaccaaagggcaaagccggggccattgggcgggctggcccccgtggccccaagggggtcaacggtacccccgggaagcatggcacaccaggcaagaaggggcccaagggcaagaagggggagccaggcctcccaggcccctgcagctgtggcagtggccataccaagtcagctttctcggtggcagtgaccaagagctacccacgggagcggctgcccatcaagtttgacaagattctgatgaacgagggtggccactacaatgcttccagcggcaagttcgtctgcggcgtgcctgggatctactacttcacctacgacatcacgctggccaacaagcacctggccatcggcctggtgcacaacggccagtaccgcatccggacctttgatgccaacaccggcaaccacgatgtggcctcaggctccaccatcctggctctcaagcagggtgacgaagtttggctgcagatcttctactcagagcagaacgggctcttctatgacccttactggacagacagcctctttacgggcttcctaatctatgccgaccaggatgaccccaacgaggtatagacatgccacggcggtcctccaggcagggaacaagcttctggacttgggcttacagagcaagaccccacaactgtaggctgggggtggggggtcgagtgagcggttctagcctcaggctcacctcctctgcctctttttttccccttcattaaatccaaacctttttattcatccaaccatctatttattcacttctttttaaagtatctactgtgtaacaggcactatgctattctctgaaagatgcagcagtggacaagacagagtatctgtcctcatgcagcttacattctagcaggagatacaatttacaaatatacaagcaaataatataatattatgccaggatagaaatgaacatgccatggttgacagtaataggaataacaggagacagggaagaggtggaaatttgtttctttttttaagtttgcgtttttaggtttacttacatacagtgactctccagattttaagttgacaactcagtgaataatttttgcttatgtgcacactctgaaacctccatgtagatcaaagaacaagctatttccaacttctcacctcccttccccaaaagctctcttaagacccctctaagtcagtacctggaaaatttccatttttgagctgagttccaaagaaggaaatagagcaacacaaaggcctcgaaaagaggtctccagcaaaaggctctgcaagtgcaaagaccttgacaggaaagagggaggggccaaggtaagaactgagaagggaggcatgaggcgtgaggctggaagataatacagaatgtcccaggccatggcagagctcgttccattcacgaaggcttatcagaatacaaagtgacactgataggcggatcatcttgaatctgctcattgcatgagtcaagtcggccacagacttgagcgctttattattagttaatcttttgcaggcccgcttctcaatgaatgagatacaccaggatatgcacgtgcatctgagaaccgctgctctgagatggcaggaatggatcccacgcaaatgaatcgcaccccaagcacaggtgttgccagtatgcagggatctgggggcttaagaagctgcagtaaaagtgccaggtgctggcgggatgtggtagctcatgcctataatcccaggactttgggaagctgaggtggacggatcatttgaggtcaggagttcaagaccagcctgaccaacatggcaaaacatcgtctaaaaaaatacaaaaattagacaggcgtggtgttgggtgcctgtaatcccagctactggggaggctgaggcgggagaatcgcttgaacccaggaggtggaggttgcagttagctgagatcctgccactgcactccagcctgggcaacagagtgagactatctcaaaaaaaaacaaaaaaaaaaaaaaaacaa

SEQ ID NO: 112653 - DNA, 1959 bp, Homo sapiens
  Payload ID: 2037
  Gene Symbol: C1QTNF3
  Gene Name: C1q and tumor necrosis factor related protein 3
  Uniprot ID: Q9BXJ4
  ENST ID: ENST00000231338
  CDS Start-End: 89-829
agctccagtcctggcatctgcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtaaatatatgactagaatagctccactttggggaagacttgtagctgagctgatttgttacgatctgaggaacattaaagttgagggttttacattgctgtattcaaaaaattattggttgcaatgttgttcacgctacaggtacaccaataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactactctgcttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtggggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgttaaagatactttctaaacttgtgtttaataaactttaatagtcatagaattgtaaatcactatggttaacagaaagtgaaaatattttcatgcagatgatgtgaacagccatgtgaataggtgacttgggcacacagcagggtcatatgacttcagaaaacttcgcttttcagttattccattgttataatgtcaaccctttaagacattgatgtttagagggctcacaaataaaatctgaatacctgtaa

SEQ ID NO: 112654 - DNA, 2802 bp, Homo sapiens
  Payload ID: 2037
  Gene Symbol: C1QTNF3
  Gene Name: C1q and tumor necrosis factor related protein 3
  Uniprot ID: Q9BXJ4
  ENST ID: ENST00000382065
  CDS Start-End: 708-1667
ttttggcttttgggaagtcatggggaaaagaagtaaagctgagggtggcgaaatacctttgctaaacccagagacactgcacctgaatcctgctcagtgttttgtaggcaaccaactgccttctgccactggtatccggaaggggaaatgagttaccttaagtgggccaaagtggggaaatactaacagtacagctagaaaccaagagctgtcgtgaaagccctgaatgggttcccactgctatttcagacaaaactgatgcagttaagcctgaatttcctggcaagcacaagggtagatttttccaaaaggctttttagactgcaaatacacagcctttccatgtctaatcacaaaagcaaactgctggacacatgctctctgttcccagctggttgtgtatgttttcttcacacttcaacagaaacgtgccaaggtgtgacatttatgaatttcgccaactgggaactgtgcacacaaatcgttcttgcttgtggtgtgggaaaatgatgaatgggggctgttctgcctggggaggagggctgctgtcactctggcatgcctacagccttatttattacacaccaaagtataaaaccactccgccgctgcagctctcagctccagtcctggcatctgcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggaggtgagcggaagaactaataaagtggtggcaagaatagtgcaaagccaccagcagactggccgtagcggctccaggagggagaaagtgagagagcggagccatcctaaaactgggactgtggataataacacttctacagacctaaaatccctgagaccagatgagctaccgcaccccgaggtagatgacctagcccagatcaccacattctggggccagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtaaatatatgactagaatagctccactttggggaagacttgtagctgagctgatttgttacgatctgaggaacattaaagttgagggttttacattgctgtattcaaaaaattattggttgcaatgttgttcacgctacaggtacaccaataatgttggacaattcaggggctcagaagaatcaaccacaaaatagtcttctcagatgaccttgactaatatactcagcatctttatcactctttccttggcacctaaaagataattctcctctgacgcaggttggaaatatttttttctatcacagaagtcatttgcaaagaattttgactactctgcttttaatttaataccagttttcaggaacccctgaagttttaagttcattattctttataacatttgagagaatcggatgtagtgatatgacagggctggggcaagaacaggggcactagctgccttattagctaatttagtgccctccgtgttcagcttagcctttgaccctttccttttgatccacaaaatacattaaaactctgaattcacatacaatgctattttaaagtcaatagattttagctataaagtgcttgaccagtaatgtggttgtaattttgtgtatgttcccccacatcgcccccaacttcggatgtggggtcaggaggttgaggttcactattaacaaatgtcataaatatctcatagaggtacagtgccaatagatattcaaatgttgcatgttgaccagagggattttatatctgaagaacatacactattaataaataccttagagaaagattttgacctggctttagataaaactgtggcaagaaaaatgtaatgagcaatatatggaaataaacacacctttgttaaagatactttctaaacttgtgtttaataaactttaatagtcatagaattgtaaatcactatggttaacagaaagtgaaaatattttcatgcagatgatgtgaacagccatgtgaataggtgacttgggcacacagcagggtcatatgacttcagaaaacttcgcttttcagttattccattgttataatgtcaaccctttaagacattgatgtttagagggctcacaaataaaatctgaatacctgtaaggaaa

SEQ ID NO: 112655 - DNA, 1664 bp, Homo sapiens
  Payload ID: 2038
  Gene Symbol: C1QTNF4
  Gene Name: C1q and tumor necrosis factor related protein 4
  Uniprot ID: Q9BXJ3
  ENST ID: ENST00000302514
  CDS Start-End: 518-1507
aggaaggaagctggactgtagagcgctctgggccaccccgcgttagctgctgcctctggcctcagtttccccaactgctcagattaatgatgcctgctctctagacccagaggacgaagctctaaggaggtcacagatgaggaagggtccagtgctcggcgcagactccgtgcggagcccctaggccccgcagctcgcccctccctctcccctactcccctcctctccccctcccgtctctcccccgcctcttcgctctcgctcggctccctctctagctgaccttccctttccctcacgcctccccacgcccggcccctggccccagcaccctgtccgctgccgcctcagagccgggaaaagcagccggagcccccgccgcccctgccgcagcgcgggcggtcagcgcgcagcccggcacccgcagcctgcagcctgcagcccgcagcccgcagcccggagccagatcgcgggctcagaccgaacccgactcgaccgccgcccccagccaggcgccatgctgccgcttctgctgggcctgctgggcccagcggcctgctgggccctgggcccgacccccggcccgggatcctctgagctgcgctcggccttctcggcggcacgcaccacccccctggagggcacgtcggagatggcggtgaccttcgacaaggtgtacgtgaacatcgggggcgacttcgatgtggccaccggccagtttcgctgccgcgtgcccggcgcctacttcttctccttcacggctggcaaggccccgcacaagagcctgtcggtgatgctggtgcgaaaccgcgacgaggtgcaggcgctggccttcgacgagcagcggcggccaggcgcgcggcgcgcagccagccagagcgccatgctgcagctcgactacggcgacacagtgtggctgcggctgcatggcgccccgcagtacgcgctaggcgcgcccggcgccaccttcagcggctacctagtctacgccgacgccgacgctgacgcgcctgcgcgcgggccgcccgcgccccccgagccgcgctcggccttctcggcggcgcgcacgcgcagcttggtgggctcggacgctggccccgggccgcggcaccaaccactcgccttcgacaccgagttcgtcaacattggcggcgacttcgacgcggcggccggcgtgttccgctgccgtctgcccggcgcctacttcttctccttcacgctgggcaagctgccgcgtaagacgctgtcggttaagctgatgaagaaccgcgacgaggtgcaggccatgatttacgacgacggcgcgtcgcggcgccgcgagatgcagagccagagcgtgatgctggccctgcggcgcggcgacgccgtctggctgctcagccacgaccacgacggctacggcgcctacagcaaccacggcaagtacatcaccttctccggcttcctggtgtaccccgacctcgcccccgccgccccgccgggcctcggggcctcggagctactgtgagccccgggccagagaagagcccgggagggccaggggcgtgcatgccaggccgggccggaggctcgaaagtcccgcgcgagcgccacggcctccgggcgcgcctggactctgccaataaagcggaaagcgggcacgcgcagcgcccggcagcccaggc

SEQ ID NO: 112656 - DNA, 530 bp, Homo sapiens
  Payload ID: 2038
  Gene Symbol: C1QTNF4
  Gene Name: C1q and tumor necrosis factor related protein 4
  ENST ID: ENST00000530097
  CDS Start-End: 1-301
atgctgccgcttctgctgggcctgctgggcccagcggcctgctgggccctgggcccgacccccggcccgggatcctctgagctgcgctcggccttctcggcggcacgcaccacccccctggagggcacgtcggagatggcggtgaccttcgacaaggtgtacgtgaacatcgggggcgacttcgatgtggccaccggccagtttcgctgccgcgtgcccggcgcctacttcttctccttcacggctggcaaggccccgcacaagagcctgtcggtgatgctggtgcgaaaccgcgacgaggtgcaggccatgatttacgacgacggcgcgtcgcggcgccgcgagatgcagagccagagcgtgatgctggccctgcggcgcggcgacgccgtctggctgctcagccacgaccacgacggctacggcgcctacagcaaccacggcaagtacatcaccttctccggcttcctggtgtaccccgacctcgcccccgccgccccgccgggcctcggggcctcggagctactgtg

SEQ ID NO: 112657 - DNA, 1356 bp, Homo sapiens
  Payload ID: 2039
  Gene Symbol: C1QTNF5
  Gene Name: C1q and tumor necrosis factor related protein 5
  Uniprot ID: Q9BXJ0
  ENST ID: ENST00000528368
  CDS Start-End: 233-964
gaacaactggtttcctcttggagtctgggaggaggaaagcggagccggcagggagcgaaccaggactggggtgacggcagggcagggggcgcctggccggggagaagcgcgggggctggagcaccaccaactggagggtccggagtagcgagcgccccgaaggaggccatcggggagccgggaggggggactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggcacgccgggccaccatggcagccagggcttgccgggccgcgatggccgcgacggccgcgacggcgcgcccggggctccgggagagaaaggcgagggcgggaggccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctccta

SEQ ID NO: 112658 - DNA, 1046 bp, Homo sapiens
  Payload ID: 2039
  Gene Symbol: C1QTNF5
  Gene Name: C1q and tumor necrosis factor related protein 5
  Uniprot ID: Q9BY79
  ENST ID: ENST00000530681
  CDS Start-End: 171-902
cggccctgcgagcgctcagcctcaggggcacggcagtggggtggggaccgactgggccgcgccggggtggggagagaggcaggtcccaggattctgggtcccgactccagtcctgcctggtccacagactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggcacgccgggccaccatggcagccagggcttgccgggccgcgatggccgcgacggccgcgacggcgcgcccggggctccgggagagaaaggcgagggcgggaggccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctgg

SEQ ID NO: 112659 - DNA, 469 bp, Homo sapiens
  Payload ID: 2039
  Gene Symbol: C1QTNF5
  Gene Name: C1q and tumor necrosis factor related protein 5
  ENST ID: ENST00000634633
  CDS Start-End: 290-469
gggcgacaccacgagttatttcccagctatttcccggtccgggagctcttggcccctgaacaactggtttcctcttggagtctgggaggaggaaagcggagccggcagggagcgaaccaggactggggtgacggcagggcagggggcgcctggccggggagaagcgcgggggctggagcaccaccaactggagggtccggagtagcgagcgccccgaaggaggccatcggggagccgggaggggggactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggactgccgggacctcgaggggaccccgggccgcgaggagaggcgggacccgcggggcccaccgggcctgccggg

SEQ ID NO: 112660 - DNA, 2934 bp, Homo sapiens
  Payload ID: 2040
  Gene Symbol: C1QTNF6
  Gene Name: C1q and tumor necrosis factor related protein 6
  Uniprot ID: Q9BXI9
  ENST ID: ENST00000337843
  CDS Start-End: 77-913
ccctcctctgctgggcctgggggtctgggccagcaacaagttagtattgcagacatgggccaaggagccagaggccatgcagtggctcagggtccgtgagtcgcctggggaggccacaggacacagggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcaggtgctggtcccgtcccctgcagggctcagtttgcactgctgtgaagcaggaaggccagggaggtccccggggacctggcattctggggagaccctgcttctatcttggctgccatcatccctcccagcctatttctgctcctctcttctctcttggacctattttaagaagcttgctaacctaaatattctagaactttcccagcctcgtagcccagcacttctcaaacttggaaatgcatgcgaatcacccggggttcgtgttaaatgcagattctgactcagcaggtctgagtgggtccaggattctgtgtttctcatatgttcctgggtgatgctgatggggtcagtctatgaaccacactggagcaaccaggttctaggactttctcaatattctagtactttctgaacattctggaatcctccccacattctagaattctcccaacatttttttttcttgagacagagtcttgctctgttgcccaggctagagtgcagtggtgcaatctcagttcactgcaacctctgcctcccgggttcaagcgattcttctgcctcagcctccctagtggctgggattacaggcgcctgctaccatgcctggctaatttttgtatttttagtagagatggggtttcaccatattggccaggctggtcttgaactcctgacttcaggtgacccacccgcctcggcctctcaaaatgctgggattacaggtgtgagccaccgtgcctggccaattccaacattcttaaattctctcatccctccagggctccccgtgctatgttctctttaccccttccccctcttctcttgctcaggcctgcaccactgcagccaccgttcatttattcattcattaaacactgagcactcactctgtgctgggtcccgggaagggtgagggggtcagacacaggccctgcccctgccctcagtgactggccagtccagcccaggcggggagagatgtgtacataggttttaaagcagacccagagctcatgggggcctgtgttctgggtgttcaggtgctgctggtcctccattacccactgctccccaaggctggtgggacggggtcccggtggcaggggcaggtatctccttcccgttcctcatccacctgcccagtgctcatcgttacagcaaaccccagggggccttggccaggtcaagggttctgtgaggagaggacccaggagtgtgggggcatttggggggtgaagtggcccccgaagaatggaacccacacccatagctctccccacagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgaggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttgg

SEQ ID NO: 112661 - DNA, 1647 bp, Homo sapiens
  Payload ID: 2040
  Gene Symbol: C1QTNF6
  Gene Name: C1q and tumor necrosis factor related protein 6
  Uniprot ID: Q9BXI9
  ENST ID: ENST00000397110
  CDS Start-End: 74-910
tcctctgctgggcctgggggtctgggccagcaacaagttagtattgcagacatgggccaaggagccagaggccatgcagtggctcagggtccgtgagtcgcctggggaggccacaggacacagggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggccaccctcccggctggagagctcagctgatacggcatcctgcgagaagacctgccctcctcactgggatccccttcctgcctcctcccagggctctgccagggccttgctcagtcccttccaccaaagtcatctgaacttccgtttccccagggcctccagctgccctcagacactgatgtctgtccccaggtgctctctgcccctcatgcccctctcaccggcccagtgccccgactctccaggctttatcaaggtgctaaggcccgggtgggcagctcctcgtctcagagccctcctccggcctggtgctgcctttacaaacacctgcaggagaagggccacggaagccccaggctttagagccctcagcaggtctggggagctagagcaaaggagggacctcaggccttccgtttcttcttccagggtggggtggcctggtgttcccctagccttccaaacccaggtggcctgcccttctccccagagggaggcggcctccgcccattggtgctcatgcagactctggggctgaggtgccccggggggtgatctctggtgctcacagccgaggagccgtggctccatggccagatgacggaaacagggtctgaccaagtgccaggaagacctgtgctataaaccaccctgcctgatcctgcccctgcctgaccccgccacgccctgccgtccagcatgattaaagaatgctgtctcctcttgg

SEQ ID NO: 112662 - DNA, 975 bp, Homo sapiens
  Payload ID: 2040
  Gene Symbol: C1QTNF6
  Gene Name: C1q and tumor necrosis factor related protein 6
  ENST ID: ENST00000434784
  CDS Start-End: 24-374
catgggccaaggagccagaggccatgcagtggctcagggtccgtgagtcgcctggggaggccacaggacacagggtcaccatggggacagccgccctgggtcccgtctgggcagcgctcctgctctttctcctgatgtgtgagatccctatggtggagctcacctttgacagagctgtggccagcggctgccaacggtgctgtgactctgaggaccccctggatcctgcccatgtatcctcagcctcttcctccggccgcccccacgccctgcctgagatcagaccctacattaatatcaccatcctgaagggacgtggaaggactcgcttcccttccaggctgtggtggctgacggctgtgaccaggccttgacatccttagcgtccgtctctgcccacaacagcccgtgaggtgacaaaggggacccaggcccaatgggcctgccagggtacatgggcagggagggtccccaaggggagcctggccctcagggcagcaagggtgacaagggggagatgggcagccccggcgccccgtgccagaagcgcttcttcgccttctcagtgggccgcaagacggccctgcacagcggcgaggacttccagacgctgctcttcgaaagggtctttgtgaaccttgatgggtgctttgacatggcgaccggccagtttgctgctcccctgcgtggcatctacttcttcagcctcaatgtgcacagctggaattacaaggagacgtacgtgcacattatgcataaccagaaagaggctgtcatcctgtacgcgcagcccagcgagcgcagcatcatgcagagccagagtgtgatgctggacctggcctacggggaccgcgtctgggtgcggctcttcaagcgccagcgcgagaacgccatctacagcaacgacttcgacacctacatcaccttcagcggccacctcatcaaggccgaggacgactgagggcctctgggcca

SEQ ID NO: 112663 - DNA, 4516 bp, Homo sapiens
  Payload ID: 2041
  Gene Symbol: C1QTNF7
  Gene Name: C1q and tumor necrosis factor related protein 7
  Uniprot ID: Q9BXJ2
  ENST ID: ENST00000295297
  CDS Start-End: 260-1150
gggagaaggagtgggaggttgtttaaactgagaaagacagttgcaaaacttcgtacaacagcatgagctccaagcttcaaacgcattctcatgctcagacgagcactttatttttcatcaagttattttttgcattgttttggagtagcttcgaataataaacacatatttctgctttaaatttttaatagttaactacattcatgggacaaccaaagcaagaaagcctcatgttttgggggaaagtttgatatcagcaatgtccagacaagagccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaaggagaagtaggtccaattggtcctcctggaccaaagggagacagaggagaacaaggggacccggggctgcctggagtttgcagatgtggaagcatcgtgctcaaatccgccttttctgttggcatcacaaccagctacccagaagaaagactacctattatatttaacaaggtcctcttcaacgagggagagcactacaaccctgccacagggaagttcatctgtgctttcccagggatctattacttttcttatgatatcacattggctaataagcatctggcaatcggactggtacacaatgggcaataccggataaagaccttcgacgccaacacaggaaaccatgatgtggcttcggggtccacagtcatctatctgcagccagaagatgaagtctggctggagattttcttcacagaccagaatggcctcttctcagacccaggttgggcagacagcttattctccgggtttctcttatacgttgacacagattacctagattccatatcagaagatgatgaattgtgatcaggaccaagatccctgtggtaaacactctgattgaatctggggttccagaaggtggaacaagcaggaatgggatccaaagagactcccactcagattctaaagcatttaaagacaattctagcagaatttatcaaaacaagatgaaacacagaaaagttgaaaccacaacaaaatgaattctattaaagaatagccccagatataaattctcttgaaagcaatgttcataaatatttaagcaaattaaagacaatgttaacaaattttctattaaatgccctgagtgataaaaccagttggcaataatattgccttattaaatcttcaaaaaatatattttagtctgttatttaagaaaaacataacatcccaaaatctttgacaattctcgaaaggctatatagtaagtcaaaaaccaaaggtaagagatgctaactatttttcaagcaagctacagagaaatgataaatgttttttgttttattatttattccttcatgtttgtatatattcactcaacaaccctttaatgagcctgtaaggaccagacactgtggcgctgaatcagatttaataatgagttaagacaaagcccctacctatgggctagtgtgtggtgatcaaactatcacaattcagtgtgatgagcagcatagcaaacagatggatttgaagctaaaagcacacagggtctgctattcctgaggctgggggccagagaagcttttacgcatggaaaaacactaatcatgccaaggtgtatgtgtttaagggggtgtgatggatgcaaagggaatgaggaattcagcactgcattctctttgcaccctcaatgcatgattggtattctcaacagcaaaggggtgaaaaatctagagacagaggaggcctggcaggggtgataaaaatggagattgaaatgaagagaaatagccagcaggtgattcttctgaatcctttagtgtgatggtttcccaagacaaacatttgtcctaatagctttctcataaatatgggcaccactttacattgtggtaagacattgcttctcatggatctgctaggtatttatttcaaataaagcaaggcatatgttcactgatttacgagtaagctgatgagagcaatgaacaggagaaggagggagagagccaaatgtctgagtaaacagatatcccttccaagtctcacacctcccttagtcccactcttgcttgtgtcagcaccttgttcttcactgaactgcaattcttcaattattctcttccatgattttgtctgatctaccatttctatggtttatggtaatagtattccctttatccctcccttttggtaacttccaatcctccttctatgtattcctttctctgctcattgacttataaatagttttcatacctcttatgtttgaatcaccatgctagattctgtgaagacagaagagtatcaagattaatatattaatagtatagctctgactggtaaatttcttttttttaatcttccccaatttaaattttttaatttaaaagtaaattttactgtcgaaaatgcaaacttggggagggcggaaacatcacacacaaggtttccacttcacacttggagggttgcatggcggctgggcaaaggtgctccccacttcccagatggtgcggcggctggccagaggcactcttcacttcccagacagaggggcggccgggcagaggtgctcctcacttcccagagggtgcaggagccagctctgactagtaaatttctaaggataccagaaaggaaatggcatgcacacacacaaaaaatacctaaattttggatgagaaaatgataaaatatgctaagttctaggctggaaataagggcaaaatgctgtgaaagaagaggaaatgtttacttccaaattaggatgtgacagagaagggatagggaaatcctctctgctcattgggccttacatgatgggtgacacttggagtggcacaagttgggggaaagcgcacttgagacagaggtaatgatggggacgaagtgagaacagagacccagaaggagaatcaatggaccatatttgtaagagctttgaaagccagcctgagaattggaggatttattcataagaaagtgtagagaccctgtgtatttcagagctggatactgccattaccacagatgaaagttgcaatgatctagcagttgtgtgcaaaggcaaggcttgcttttcctgtctttcaaccctatcttgcttttcctgtctttcaaccctatcttgctttcattgtcttcatcttcctgccatactttgtgcacttattgctctccttctgagtcaggacatgtgtacaggagaccaagaacaatgagtattagaaaaaaaggagacagcaaaggtggtttgaggtagtcacctgcttacagataacagccaaagatagaattccaagttataaagcataaaaaagagccaacagaagtaactaatccgggaaaagtgaacatatgggccctttaaagactacaagatttgctagataaactggaaatggagaagttattgcagacagtcatgaaccacaaatcactgtgattaaaattttcttctgatcgtaatccacgaatgcattcattttttggacattgcttacttatcttttaaatgtttcttttattacaaagcctattttgagtagcttttaaaactgaatttcctttaattggtttgaagcctagagatgaatttcgttttcaaatatctggtgggatggtaatggggattagagaactgacatgagaaaagaggagctgttttggtattaaacgaataaaatcttaagcaaatataggtgtcttttattcttaaaaaatagcagatacagtttatccacatttgtaaatatttgtataaagaaagtagcaaaacagttttggtttaaaaagttccaagtctcattgcaatcattctttgtaaaggctgacttgtaatgaatatgtattaagcaatatttattgactatacaccatcttgttctagaagagtttaaagccacttaagaagataaataagatataaaaagaaaacagcagtcaaaagcagatgagaagaaatgggaaaaacaaaaaaaaaagaaaataatgaggctaatataatgctgtgtgtacatgaacatgaatgtgcctgtgttacacattttcaggccacaaatgtttctttgtgcccctgcatgcacaagggtatttccaggtcatttatcattgtgaacagtgttgcttatgataaaaaatagattctataaactctaaatatactttttttctaccactctgtgtaaaagatcatgaacgtaaataaattttagatat

SEQ ID NO: 112664 - DNA, 566 bp, Homo sapiens
  Payload ID: 2041
  Gene Symbol: C1QTNF7
  Gene Name: C1q and tumor necrosis factor related protein 7
  ENST ID: ENST00000382383
  CDS Start-End: 230-566
cattgcacgccggggtccttgcccgctccctctctctgccaccgctcaaagcctgggagaacgcttttgaaagcgaatcaggaaattacttatcaatctgaagccccaaagaattatgaataatcctcgctgccaaagggaaggggattttgagcaaaagctccacatctgcgcacactagagttcaaagactccagctgttggaaggtcttgtgagcaatagccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaag

SEQ ID NO: 112665 - DNA, 583 bp, Homo sapiens
  Payload ID: 2041
  Gene Symbol: C1QTNF7
  Gene Name: C1q and tumor necrosis factor related protein 7
  ENST ID: ENST00000397700
  CDS Start-End: 130-583
agaagaacactacccactcctacttgttcttaactagtgtatatattaagctctttgaaatttaactacattcatgggacaaccaaagcaagaaagcctcatgttttgggggaaagtttgatatcagcaatgtccagacaagagccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaaggagaagtaggtccaattggtcctcctggaccaaagggagacagaggagaacaaggggacccggggctgcctggagtttgcagatgtggaagcatcg

SEQ ID NO: 112666 - DNA, 1533 bp, Homo sapiens
  Payload ID: 2041
  Gene Symbol: C1QTNF7
  Gene Name: C1q and tumor necrosis factor related protein 7
  Uniprot ID: Q9BXJ2
  ENST ID: ENST00000444304
  CDS Start-End: 327-1196
gaggccacaacacacagagatggagaagctctaaacttaccactgaaggaaagcaggcacttaaagtttatcccaaacaaaactgtaattttaactggtccccgagttgagcctcactcgatgaatgacttccagggcctttggctctttgggactaaacgagaaaattatttttagcacaactatttggaaatctttgagaatttggatctgttattctgtctggtaccaaagcaagtttttcactgagctctcatgaaagatcctcagtctcttgtggatttagaatcctgcagcagcccaccatctaagagcaagagccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaaggagaagtaggtccaattggtcctcctggaccaaagggagacagaggagaacaaggggacccggggctgcctggagtttgcagatgtggaagcatcgtgctcaaatccgccttttctgttggcatcacaaccagctacccagaagaaagactacctattatatttaacaaggtcctcttcaacgagggagagcactacaaccctgccacagggaagttcatctgtgctttcccagggatctattacttttcttatgatatcacattggctaataagcatctggcaatcggactggtacacaatgggcaataccggataaagaccttcgacgccaacacaggaaaccatgatgtggcttcggggtccacagtcatctatctgcagccagaagatgaagtctggctggagattttcttcacagaccagaatggcctcttctcagacccaggttgggcagacagcttattctccgggtttctcttatacgttgacacagattacctagattccatatcagaagatgatgaattgtgatcaggaccaagatccctgtggtaaacactctgattgaatctggggttccagaaggtggaacaagcaggaatgggatccaaagagactcccactcagattctaaagcatttaaagacaattctagcagaatttatcaaaacaagatgaaacacagaaaagttgaaaccacaacaaaatgaattctattaaagaatagccccagatataaattctcttgaaagcaatgttcataaatatttaagcaaattaaagacaatgttaacaaattttctattaaatgccctgagtgataaaaccagttggcaataatattgccttattaaatcttcaaaaaata

SEQ ID NO: 112667 - DNA, 4464 bp, Homo sapiens
  Payload ID: 2041
  Gene Symbol: C1QTNF7
  Gene Name: C1q and tumor necrosis factor related protein 7
  Uniprot ID: Q9BXJ2
  ENST ID: ENST00000429690
  CDS Start-End: 228-1097
ttgcacgccggggtccttgcccgctccctctctctgccaccgctcaaagcctgggagaacgcttttgaaagcgaatcaggaaattacttatcaatctgaagccccaaagaattatgaataatcctcgctgccaaagggaaggggattttgagcaaaagctccacatctgcgcacactagagttcaaagactccagctgttggaaggtcttgtgagcaatagccaaagatgtttgtcttgctctatgttacaagttttgccatttgtgccagtggacaaccccggggtaatcagttgaaaggagagaactactcccccaggtatatctgcagcattcctggcttgcctggacctccagggccccctggagcaaatggttcccctgggccccatggtcgcatcggccttccaggaagagatggtagagacggcaggaaaggagagaaaggtgaaaagggaactgcaggtttgagaggtaagactggaccgctaggtcttgccggtgagaaaggggaccaaggagagactgggaagaaaggacccataggaccagagggagagaaaggagaagtaggtccaattggtcctcctggaccaaagggagacagaggagaacaaggggacccggggctgcctggagtttgcagatgtggaagcatcgtgctcaaatccgccttttctgttggcatcacaaccagctacccagaagaaagactacctattatatttaacaaggtcctcttcaacgagggagagcactacaaccctgccacagggaagttcatctgtgctttcccagggatctattacttttcttatgatatcacattggctaataagcatctggcaatcggactggtacacaatgggcaataccggataaagaccttcgacgccaacacaggaaaccatgatgtggcttcggggtccacagtcatctatctgcagccagaagatgaagtctggctggagattttcttcacagaccagaatggcctcttctcagacccaggttgggcagacagcttattctccgggtttctcttatacgttgacacagattacctagattccatatcagaagatgatgaattgtgatcaggaccaagatccctgtggtaaacactctgattgaatctggggttccagaaggtggaacaagcaggaatgggatccaaagagactcccactcagattctaaagcatttaaagacaattctagcagaatttatcaaaacaagatgaaacacagaaaagttgaaaccacaacaaaatgaattctattaaagaatagccccagatataaattctcttgaaagcaatgttcataaatatttaagcaaattaaagacaatgttaacaaattttctattaaatgccctgagtgataaaaccagttggcaataatattgccttattaaatcttcaaaaaatatattttagtctgttatttaagaaaaacataacatcccaaaatctttgacaattctcgaaaggctatatagtaagtcaaaaaccaaaggtaagagatgctaactatttttcaagcaagctacagagaaatgataaatgttttttgttttattatttattccttcatgtttgtatatattcactcaacaaccctttaatgagcctgtaaggaccagacactgtggcgctgaatcagatttaataatgagttaagacaaagcccctacctatgggctagtgtgtggtgatcaaactatcacaattcagtgtgatgagcagcatagcaaacagatggatttgaagctaaaagcacacagggtctgctattcctgaggctgggggccagagaagcttttacgcatggaaaaacactaatcatgccaaggtgtatgtgtttaagggggtgtgatggatgcaaagggaatgaggaattcagcactgcattctctttgcaccctcaatgcatgattggtattctcaacagcaaaggggtgaaaaatctagagacagaggaggcctggcaggggtgataaaaatggagattgaaatgaagagaaatagccagcaggtgattcttctgaatcctttagtgtgatggtttcccaagacaaacatttgtcctaatagctttctcataaatatgggcaccactttacattgtggtaagacattgcttctcatggatctgctaggtatttatttcaaataaagcaaggcatatgttcactgatttacgagtaagctgatgagagcaatgaacaggagaaggagggagagagccaaatgtctgagtaaacagatatcccttccaagtctcacacctcccttagtcccactcttgcttgtgtcagcaccttgttcttcactgaactgcaattcttcaattattctcttccatgattttgtctgatctaccatttctatggtttatggtaatagtattccctttatccctcccttttggtaacttccaatcctccttctatgtattcctttctctgctcattgacttataaatagttttcatacctcttatgtttgaatcaccatgctagattctgtgaagacagaagagtatcaagattaatatattaatagtatagctctgactggtaaatttcttttttttaatcttccccaatttaaattttttaatttaaaagtaaattttactgtcgaaaatgcaaacttggggagggcggaaacatcacacacaaggtttccacttcacacttggagggttgcatggcggctgggcaaaggtgctccccacttcccagatggtgcggcggctggccagaggcactcttcacttcccagacagaggggcggccgggcagaggtgctcctcacttcccagagggtgcaggagccagctctgactagtaaatttctaaggataccagaaaggaaatggcatgcacacacacaaaaaatacctaaattttggatgagaaaatgataaaatatgctaagttctaggctggaaataagggcaaaatgctgtgaaagaagaggaaatgtttacttccaaattaggatgtgacagagaagggatagggaaatcctctctgctcattgggccttacatgatgggtgacacttggagtggcacaagttgggggaaagcgcacttgagacagaggtaatgatggggacgaagtgagaacagagacccagaaggagaatcaatggaccatatttgtaagagctttgaaagccagcctgagaattggaggatttattcataagaaagtgtagagaccctgtgtatttcagagctggatactgccattaccacagatgaaagttgcaatgatctagcagttgtgtgcaaaggcaaggcttgcttttcctgtctttcaaccctatcttgcttttcctgtctttcaaccctatcttgctttcattgtcttcatcttcctgccatactttgtgcacttattgctctccttctgagtcaggacatgtgtacaggagaccaagaacaatgagtattagaaaaaaaggagacagcaaaggtggtttgaggtagtcacctgcttacagataacagccaaagatagaattccaagttataaagcataaaaaagagccaacagaagtaactaatccgggaaaagtgaacatatgggccctttaaagactacaagatttgctagataaactggaaatggagaagttattgcagacagtcatgaaccacaaatcactgtgattaaaattttcttctgatcgtaatccacgaatgcattcattttttggacattgcttacttatcttttaaatgtttcttttattacaaagcctattttgagtagcttttaaaactgaatttcctttaattggtttgaagcctagagatgaatttcgttttcaaatatctggtgggatggtaatggggattagagaactgacatgagaaaagaggagctgttttggtattaaacgaataaaatcttaagcaaatataggtgtcttttattcttaaaaaatagcagatacagtttatccacatttgtaaatatttgtataaagaaagtagcaaaacagttttggtttaaaaagttccaagtctcattgcaatcattctttgtaaaggctgacttgtaatgaatatgtattaagcaatatttattgactatacaccatcttgttctagaagagtttaaagccacttaagaagataaataagatataaaaagaaaacagcagtcaaaagcagatgagaagaaatgggaaaaacaaaaaaaaaagaaaataatgaggctaatataatgctgtgtgtacatgaacatgaatgtgcctgtgttacacattttcaggccacaaatgtttctttgtgcccctgcatgcacaagggtatttccaggtcatttatcattgtgaacagtgttgcttatgataaaaaatagattctataaactctaaatatactttttttctaccactctgtgtaaaagatcatgaacgtaaataaattttagatatg

SEQ ID NO: 112668 - DNA, 1627 bp, Homo sapiens
  Payload ID: 2042
  Gene Symbol: C1QTNF8
  Gene Name: C1q and tumor necrosis factor related protein 8
  Uniprot ID: P60827
  ENST ID: ENST00000328449
  CDS Start-End: 275-1033
gcccagaggaagccacgggcgcccaggcgggcatgaaagggctctttgacggctgggttgctgggacagtaacacagacggccggccaggaggaaggaccttgccctgtgctacaatcccagagggcttcctgaaggaggcagcctagatctttgtccagcagagcccatcttcagggaatattgaggatcccgacccgtgcacctgccctagcggaagacactcctggccaagcctccagatgtggctgtgaggggagtgggccctggccaagatggcagcccccgccctgctgctcctagcactgctgctgcccgtgggggcctggcccgggctgcccaggaggccctgtgtgcactgctgccgcccggcctggccccctggaccctatgcccgggtgagtgacagggacctgtggaggggggacctgtggagggggctgcctcgagtacggcccactatagacatcgaaatcctcaaaggtgagaagggtgaggccggcgtccgaggtcgggccggcaggagcgggaaagaggggccgccaggcgcccggggcctgcagggccgcagaggccagaaggggcaggtggggccgccgggcgccgcgtgccgacgtgcctacgccgccttctccgtgggccggcgcgagggcctgcacagctccgaccacttccaggcggtgcccttcgacacggagctggtgaacctggacggcgccttcgacctggccgcgggccgcttcctctgcacggtgcccggcgtctacttcctcagcctcaacgtgcacacctggaactacaaggagacctacctgcacatcatgctgaaccggcggcccgcggccgtgctctacgcgcagcccagcgagcgcagcgtcatgcaggcccagagcctgatgctgctgctggcggcgggcgacgccgtctgggtgcgcatgttccagcgcgaccgggacaacgccatctacggcgagcacggagacctctacatcaccttcagcggccacctggtcaagccggccgccgagctgtagccggacagacgtccgcctgtggggactctgggagccccggctggcgcgcccgcctctccacttcgcctcactcctgtcctgggacagagggtgccctgcccttgggagatggtgctctgaggcccggccagagtctgcagaacccgcgtgtgtgtgctggagccactccccaggcaggcgggggaacaagcgtggcccccaacagcgcaggacaggaggaggggcggctacaggggcccgccatttgctgtgcacacatggcccctctgcagggagaggggctctgtcccggctgcgccacccccacccactgcccaagcctgctgcctcccaagtcgcccggcatccacctctttccctgaggctgtccctggggccaggctgcccctcagcacccccaagtggccccgtactcaagtcccaccttgtgtgtctgtgggggggcggtagcagggcttctggaagtgtggtgacaaccaaggacaggaggggctggggccggtggccgtggctggtgaaccctggccctgctagagacaggaggggcactggcgctggggctggacccggaaccttccctctccttcgccccac

SEQ ID NO: 112669 - DNA, 897 bp, Homo sapiens
  Payload ID: 2042
  Gene Symbol: C1QTNF8
  Gene Name: C1q and tumor necrosis factor related protein 8
  ENST ID: ENST00000621771
  CDS Start-End: 45-815
caagcctccagatgtggctgtgaggggagtgggccctggccaagatggcagcccccgccctgctgctcctagcactgctgctgcccgtgggggcctggcccgggctgcccaggaggccctgtgtgcactgctgccgcccggcctggccccctggaccctatgcccgggtgagtgacagggacctgtggaggggggacctgtggagggggctgcctcgagtacggcccactatagacatcgaaatcctcaaaggtgaggcccgtgggtgcgcctgcatgctcccccaccaggacccaacagcccagggagtggggagcacctggggcgaggaggggcgggaggggacgctgagcaccagtgtctgccctggcagcgctccctgcacagcgtgccgacgtgcctacgccgccttctccgtgggccggcgcgagggcctgcacagctccgaccacttccaggcggtgcccttcgacacggagctggtgaacctggacggcgccttcgacctggccgcgggccgcttcctctgcacggtgcccggcgtctacttcctcagcctcaacgtgcacacctggaactacaaggagacctacctgcacatcatgctgaaccggcggcccgcggccgtgctctacgcgcagcccagcgagcgcagcgtcatgcaggcccagagcctgatgctgctgctggcggcgggcgacgccgtctgggtgcgcatgttccagcgcgaccgggacaacgccatctacggcgagcacggagacctctacatcaccttcagcggccacctggtcaagccggccgccgagctgtagccggacagacgtccgcctgtggggactctgggagccccggctggcgcgcccgcctctccacttcgcctcactcctgtcctgg

SEQ ID NO: 112670 - DNA, 1830 bp, Homo sapiens
  Payload ID: 2043
  Gene Symbol: C1QTNF9
  Gene Name: C1q and tumor necrosis factor related protein 9
  Uniprot ID: P0C862
  ENST ID: ENST00000332018
  CDS Start-End: 62-1063
gcacagtatctgggtccagcctgcagccctagggtccagttcagagtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggacgtcctggcagcccggggaaggatgggacgagtggagagaagggagaacgaggagcagatggaaaagttgaagcaaaaggcatcaaaggtgatcaaggctcaagaggatccccaggaaaacatggccccaaggggcttgcagggcccatgggagagaagggcctccgaggagagactgggcctcaggggcagaaggggaataagggtgacgtgggtcccactggtcctgaggggccaaggggcaacattgggcctttgggcccaactggtttaccgggccccatgggccctattggaaagcctggtcccaaaggagaagctggacccacggggccccagggtgagccaggagtccggggaataagaggctggaaaggagatcgaggagagaaagggaaaatcggtgagactctagtcttgccaaaaagtgctttcactgtggggctcacggtgctgagcaagtttccttcttcagatatgcccattaaatttgataagatcctgtataacgaattcaaccattatgatacagcagcggggaaattcacgtgccacattgctggggtctattacttcacctaccacatcactgttttctccagaaatgttcaggtgtctttggtcaaaaatggagtaaaaatactgcacaccaaagatgcttacatgagctctgaggaccaggcctctggcggcattgtcctgcagctgaagctcggggatgaggtgtggctgcaggtgacaggaggagagaggttcaatggcttgtttgctgatgaggacgatgacacaactttcacagggttccttctgttcagcagcccgtgacagaggagagtttaaaaatccgccacaccatccatcagaatcagcttgggatgaacttattcagatggttttactttattaattcctccaattattacaataatcataaaaaggtgaaaatggaaaagttattcccaaaactgattctgtgtaacttactatttttccaggagtaaatatttaaaatagctgcatggtttattctaatttatttcacatttcttattcctattatctgaagaatccctcgtctgtgcgtttcttgtgggaagagtgttttaatatcattttagtgctctgaggagtcatatgaagatgtatccctcatctgtgtttctgaggacattaaggggaaattagagggaaatgtttattcaatttagtactagcaacagctttaagctggtgatgctgtcatactccagaaagctgtagacactgctcattttgtcttttaaaaaaattttattttattttaagttctgggatacatatgcaaaacatgcatgtttgttacataggtaaacatgtgctgtggtggtttgctgtatctatcaacccatcacctaggtattaagccctgcatgcattagctatttgtcctggtgctctccctcccactttgctcattttctaacctaggttttaatcaccattttacccaacaaatcattgttcgatcattatttgccagacttgaatctctatgtgttttctaggactgctctaataaagtacacaaactgggagtctttaaacaacagaaa

SEQ ID NO: 112671 - DNA, 1854 bp, Homo sapiens
  Payload ID: 2043
  Gene Symbol: C1QTNF9
  Gene Name: C1q and tumor necrosis factor related protein 9
  Uniprot ID: P0C862
  ENST ID: ENST00000382071
  CDS Start-End: 86-1087
tgatgtccctagacttctcagtggcaacaactcatccattcaggagctccatgtaaccactggttcagagtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggacgtcctggcagcccggggaaggatgggacgagtggagagaagggagaacgaggagcagatggaaaagttgaagcaaaaggcatcaaaggtgatcaaggctcaagaggatccccaggaaaacatggccccaaggggcttgcagggcccatgggagagaagggcctccgaggagagactgggcctcaggggcagaaggggaataagggtgacgtgggtcccactggtcctgaggggccaaggggcaacattgggcctttgggcccaactggtttaccgggccccatgggccctattggaaagcctggtcccaaaggagaagctggacccacggggccccagggtgagccaggagtccggggaataagaggctggaaaggagatcgaggagagaaagggaaaatcggtgagactctagtcttgccaaaaagtgctttcactgtggggctcacggtgctgagcaagtttccttcttcagatatgcccattaaatttgataagatcctgtataacgaattcaaccattatgatacagcagcggggaaattcacgtgccacattgctggggtctattacttcacctaccacatcactgttttctccagaaatgttcaggtgtctttggtcaaaaatggagtaaaaatactgcacaccaaagatgcttacatgagctctgaggaccaggcctctggcggcattgtcctgcagctgaagctcggggatgaggtgtggctgcaggtgacaggaggagagaggttcaatggcttgtttgctgatgaggacgatgacacaactttcacagggttccttctgttcagcagcccgtgacagaggagagtttaaaaatccgccacaccatccatcagaatcagcttgggatgaacttattcagatggttttactttattaattcctccaattattacaataatcataaaaaggtgaaaatggaaaagttattcccaaaactgattctgtgtaacttactatttttccaggagtaaatatttaaaatagctgcatggtttattctaatttatttcacatttcttattcctattatctgaagaatccctcgtctgtgcgtttcttgtgggaagagtgttttaatatcattttagtgctctgaggagtcatatgaagatgtatccctcatctgtgtttctgaggacattaaggggaaattagagggaaatgtttattcaatttagtactagcaacagctttaagctggtgatgctgtcatactccagaaagctgtagacactgctcattttgtcttttaaaaaaattttattttattttaagttctgggatacatatgcaaaacatgcatgtttgttacataggtaaacatgtgctgtggtggtttgctgtatctatcaacccatcacctaggtattaagccctgcatgcattagctatttgtcctggtgctctccctcccactttgctcattttctaacctaggttttaatcaccattttacccaacaaatcattgttcgatcattatttgccagacttgaatctctatgtgttttctaggactgctctaataaagtacacaaactgggagtctttaaacaacagaaa

SEQ ID NO: 112672 - DNA, 1212 bp, Homo sapiens
  Payload ID: 2044
  Gene Symbol: C1QTNF9B
  Gene Name: C1q and tumor necrosis factor related protein 9B
  Uniprot ID: B2RNN3
  ENST ID: ENST00000382137
  CDS Start-End: 21-1022
ttcagtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggatgtcctggcagcccggggaaggatgggacgagtggagagaagggagaacgaggagcagatggaaaagttgaagcaaaaggcatcaaaggtgatcaaggctcaagaggatccccaggaaaacatggccccaaggggcttgcagggcccatgggagagaaaggcctccgaggagagactgggcctcaggggcagaaggggaataagggtgacgtgggtcccactggtcctgaggggccaaggggcaacattgggcctttgggcccaactggtttaccgggccccatgggccctattggaaagcctggtcccaagggagaagctggacccacggggccccagggtgagccaggagtccggggaataagaggctggaaaggagatcgaggagagaaagggaaaatcggtgagactctagtcttgccaaaaagtgctttcactgtggggctcacggtgctgagcaagtttccttcttcagatgtgcccattaaatttgataagatcctgtataatgaattcaaccattatgatacagcagtggggaaattcacgtgccacattgctggggtctattacttcacctaccacatcactgttttctccaggaatgttcaggtgtctttggtcaaaaacggagtaaaaatactgcacaccagagatgcttacgtgagctctgaggaccaggcctctggcagcattgtcctgcagctgaagctcggggatgagatgtggctgcaggtgacaggaggagagaggttcaatggcttgtttgctgatgaggacgatgacacaactttcacagggttccttctgttcagcagccagtgacagaggagagtttataaatctgccagaccatccatcagaatcagcttgggatgaacttattcagatggttttactttattaattcctccaattattacaataatcataaaaaggtgaaaacggaaaagttattcccaaaactgattctatgtaacttactatttttccaggagtaaatatttaaaatagc

SEQ ID NO: 112673 - DNA, 1063 bp, Homo sapiens
  Payload ID: 2044
  Gene Symbol: C1QTNF9B
  Gene Name: C1q and tumor necrosis factor related protein 9B
  Uniprot ID: B2RNN3
  ENST ID: ENST00000382140
  CDS Start-End: 62-1063
gcgcagtatctgggtccagcctgcagccctcgggtccagttcagtgtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggatgtcctggcagcccggggaaggatgggacgagtggagagaagggagaacgaggagcagatggaaaagttgaagcaaaaggcatcaaaggtgatcaaggctcaagaggatccccaggaaaacatggccccaaggggcttgcagggcccatgggagagaaaggcctccgaggagagactgggcctcaggggcagaaggggaataagggtgacgtgggtcccactggtcctgaggggccaaggggcaacattgggcctttgggcccaactggtttaccgggccccatgggccctattggaaagcctggtcccaagggagaagctggacccacggggccccagggtgagccaggagtccggggaataagaggctggaaaggagatcgaggagagaaagggaaaatcggtgagactctagtcttgccaaaaagtgctttcactgtggggctcacggtgctgagcaagtttccttcttcagatgtgcccattaaatttgataagatcctgtataatgaattcaaccattatgatacagcagtggggaaattcacgtgccacattgctggggtctattacttcacctaccacatcactgttttctccaggaatgttcaggtgtctttggtcaaaaacggagtaaaaatactgcacaccagagatgcttacgtgagctctgaggaccaggcctctggcagcattgtcctgcagctgaagctcggggatgagatgtggctgcaggtgacaggaggagagaggttcaatggcttgtttgctgatgaggacgatgacacaactttcacagggttccttctgttcagcagccagtga

SEQ ID NO: 112674 - DNA, 888 bp, Homo sapiens
  Payload ID: 2044
  Gene Symbol: C1QTNF9B
  Gene Name: C1q and tumor necrosis factor related protein 9B
  ENST ID: ENST00000382145
  CDS Start-End: 211-510
caactacgaacatggacatctgttctagtccttgctttcaattattttgtgtagatgcacagcagtggaattgctggatcagatgcttgaagagtggttccaatcacaagtgttaccttccaaggacaatgtcatcctggtaataaccagcttgctcccctgccctgagtcttctgccaagtctgtccagttcagtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggatgtcctggcagcccggggaaggatgggacgagtggagagaagggagaacgaggagcagatggaaaagttgaagcaaaaggcatcaaaggaatgttcaggtgtctttggtcaaaaacggagtaaaaatactgcacaccagagatgcttacgtgagctctgaggaccaggcctctggcagcattgtcctgcagctgaagctcggggatgagatgtggctgcaggtgacaggaggagagaggttcaatggcttgtttgctgatgaggacgatgacacaactttcacagggttccttctgttcagcagccagtgacagaggagagtttataaatctgccagaccatccatcagaatcagcttgggatgaacttattcagatggttttactttattaattcctccaattattacaataatcataaaaaggtgaaaacggaaaagttattcccaaaactgattctatgtaacttactatttttccaggagtaaatatttaaaatagc

SEQ ID NO: 112675 - DNA, 3424 bp, Homo sapiens
  Payload ID: 2045
  Gene Symbol: C1QTNF3-AMACR
  Gene Name: C1QTNF3-AMACR readthrough (NMD candidate)
  ENST ID: ENST00000382079
  CDS Start-End: 76-930
gtgagtagtgcctcctcccatctctcttgctcctggtctcatcgtgacgggcctggtcctgcctcactttctgccatgactaagagctccctgaggcctctccagaagcagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggcaacccacttcagcaatcagaacagtgggattatcttcagcagtgttgagaccaacattggaaacttctttgatgtcatgactggtagatttggggccccagtatcaggtgtgtatttcttcaccttcagcatgatgaagcatgaggatgttgaggaagtgtatgtgtaccttatgcacaatggcaacacagtcttcagcatgtacagctatgaaatgaagggcaaatcagatacatccagcaatcatgctgtgctgaagctagccaaaggggatgaggtttggctgcgaatgggcaatggcgctctccatggggaccaccaacgcttctccacctttgcaggattcctgctctttgaaactaagtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccagg

SEQ ID NO: 112676 - DNA, 303 bp, Homo sapiens
  Payload ID: 2046
  Gene Symbol:
  Gene Name: C1QTNF9B antisense RNA 1 [Source:EntrezGene
  Acc:542767]
  ENST ID: ENST00000626707
  CDS Start-End: 1-303
atgggcatatctgaagaaggaaacttgctcagcaccgtgagccccacagtgaaagcactttttggcaagactagagtctcaccgattttccctttctctcctcgatctcctttccagcctcttattccccggactcctggctcaccctggggccccgtgggtccagcttctcctttgggaccaggctttccaatagggcccatggggcccggtaaaccagttgggcccaaaggcccaatgttgccccttggcccctcaggaccagtgggacccacgtcacccttattccccttctgcccctga

SEQ ID NO: 112677 - DNA, 5844 bp, Homo sapiens
  Payload ID: 2047
  Gene Symbol: C2CD2
  Gene Name: C2 calcium-dependent domain containing 2
  Uniprot ID: Q9Y426
  ENST ID: ENST00000329623
  CDS Start-End: 207-1832
aagactcaggggctctcttgttggtgaacagtagcaaaatctggagtaactgtgcctggaattttttggccccaagtctaaacaaaggaatagtttccagataagcgctgtttgcataggtggtggtctgtcacgtggtgggccaggctattcagttcttggtcagcgagacgcctgccttgggtgctggatgccggctgtacgacatgcggctctcccctttccatttacagctggagttccacatgaaggagaagagagaggacctccagattagctggtctttcatcagtgtgccggaaatggccgttaatatccagcccaaagcactgggggaggaccaggtggctgagacaagtgcgatgtctgacgttctcaaggacatcttgaagcatttggctggttctgcctctccatcagtggttctgattaccaagcccacgactgtaaaggaagctcagaacttacagtgtgctgcatctactgctcaggaatcctgtcctcctaaacctccaagggctcacgagctgaagctactggtgaggaacatccacgtcttgctgctcagcgagcccggtgcctcaggccacattaatgcagtgtgcgtcgtgcagctgaacgatcctgttcagaggttctccagcaccctgacgaaaaacactccggacctcatgtgggaagaggaattcaccttcgagttgaatgccaagtcgaaggagttacacctgcagatttcagaggctgggcgatcctcagaaggtctgctggcgacggcgacagttcctctggacttatttaagaagcagccttctgggccacagagcttcacgctgaccagcgggtctgcctgcggcagctcggtgctgggctcggtcacggcagagttctcttacatggaacctggtgaattgaaatcctggcccatccctccccctgttcctgctgcaaaaatagaaaaggaccgcacggtgatgccctgtgggactgtggtcactactgtcactgctgtgaagaccaagcctcgcgtcgacgtggggagggcgtccccgctgagctctgattctccggtgaagactcccatcaaggtgaaggtgatcgagaaggacatctctgtccaggccatcgcctgccgcagcgcccccgtcagcaaaacactctcttcttcagacacagaattgttggtgttgaatggttcggatccagtggctgaagtggccattcgacagctcagtgaatcttcaaagctgaaactcaagtcgccacggaagaaaagcactattatcatatcagggatctccaagacctcactatctcaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaaccggtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggatttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgttagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaagtggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaacacta

SEQ ID NO: 112678 - DNA, 6345 bp, Homo sapiens
  Payload ID: 2047
  Gene Symbol: C2CD2
  Gene Name: C2 calcium-dependent domain containing 2
  Uniprot ID: Q9Y426
  ENST ID: ENST00000380486
  CDS Start-End: 243-2333
gctcgcgcccctgttccgcaggtgtgcggggcttgcgcccagcccgggccgcggccgccgcgcgtttcctccccgcttgcccgcccagaggcccccggccacgctcctcgccgggctccgaccccgccgcgccccctccacgcccccagcgcgctgtggccgcagccagcgcgtgtcctgagtccgccgttccggcccggggctgccggggaagttggggcgaggcgggccggggatgcgccatggccatggcccggctgggctcgtggctcggggaggcgcagtggctcgcgctggtgtcgctcttcgtcgcggccctggccacggtaggcctgtacctggcgcagtgggcgctggccagggcgcgaccccagccccagcggcgggcggtggagcctggagaggggccgcgcccggggtccgacgcgctgctctcctggatcctgacgctgggcagctggaggagccagtggcaggcggcctgggtgaccgccctgaacgaggaggccgagaggaaagggggcccacctttcctgtcctttgaggaggacccgcggcagcaggcactggagctggtggtgcaggaggtctccagcgtgctcaggtcggcggaggagaaggtggtggtctgtcacgtggtgggccaggctattcagttcttggtcagcgagacgcctgccttgggtgctggatgccggctgtacgacatgcggctctcccctttccatttacagctggagttccacatgaaggagaagagagaggacctccagattagctggtctttcatcagtgtgccggaaatggccgttaatatccagcccaaagcactgggggaggaccaggtggctgagacaagtgcgatgtctgacgttctcaaggacatcttgaagcatttggctggttctgcctctccatcagtggttctgattaccaagcccacgactgtaaaggaagctcagaacttacagtgtgctgcatctactgctcaggaatcctgtcctcctaaacctccaagggctcacgagctgaagctactggtgaggaacatccacgtcttgctgctcagcgagcccggtgcctcaggccacattaatgcagtgtgcgtcgtgcagctgaacgatcctgttcagaggttctccagcaccctgacgaaaaacactccggacctcatgtgggaagaggaattcaccttcgagttgaatgccaagtcgaaggagttacacctgcagatttcagaggctgggcgatcctcagaaggtctgctggcgacggcgacagttcctctggacttatttaagaagcagccttctgggccacagagcttcacgctgaccagcgggtctgcctgcggcagctcggtgctgggctcggtcacggcagagttctcttacatggaacctggtgaattgaaatcctggcccatccctccccctgttcctgctgcaaaaatagaaaaggaccgcacggtgatgccctgtgggactgtggtcactactgtcactgctgtgaagaccaagcctcgcgtcgacgtggggagggcgtccccgctgagctctgattctccggtgaagactcccatcaaggtgaaggtgatcgagaaggacatctctgtccaggccatcgcctgccgcagcgcccccgtcagcaaaacactctcttcttcagacacagaattgttggtgttgaatggttcggatccagtggctgaagtggccattcgacagctcagtgaatcttcaaagctgaaactcaagtcgccacggaagaaaagcactattatcatatcagggatctccaagacctcactatctcaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaaccggtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggatttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgttagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaagtggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaacacta

SEQ ID NO: 112679 - DNA, 4559 bp, Homo sapiens
  Payload ID: 2047
  Gene Symbol: C2CD2
  Gene Name: C2 calcium-dependent domain containing 2
  ENST ID: ENST00000449165
  CDS Start-End: 1-547
aagcactattatcatatcagggatctccaaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattataggattttttcttttttagtaaaaaccggtatcaaaaccaaaattataggatttttttcttttttagtaaaaacctatataaaaaccaaaattataggattttttcttttttagtaaaaacctatatgaaaaccaaaattataggatttttttcttttttagtaaaaacctgtataaaaaccaaaattataggatttttttttcttcttttttagagagagagattagaaaacgacattaggaatttcactttaaaatgcgcattacaaacttcttaggtgttccaggaattatcaagtgactttaaaatgacttttccaacctgctttgtttttaaaaattatattccagttttaatcattgtaaaaaaagcacctggagtttcaaaacatgtgaatactaccaagtttctgtccccaaagtcaggcatcactgttagtcttttgggacagatgggacagatgttcactttaatgttttacttgaagttttactgctctttgccatgtggtaaaaagaggctgagacatatttaagaattccaagaggatattatgtgtcagaatttcagacactgatgagaagtttttaattgttcttttttatttgattttggaattcaggtgcactctattcaagtgcaaggatatcagaagtttttttttatttaaaaaatttttttttcgagatggagtttcactctgttgcccaggctggagtgcaatggcagcttactgcaacctccacctcctggttcaagcgattctcctgcctcagcctcccaagtagctgggattacaggcacgcgccaccacacctggctaattctatttagtagaaatggagtctcaccatgttggtcaggctggtctcgaactcctgacctcaggtgatccacccaccttggcctcccagcgtgctgggattataggcatgagccaccaggccggccccaggattttatattaagccttcttgctctcaaaaaaaaaaaaaggttttaactattccatttccagatgaatcccatgagcgctgcttactgttgaataccaaggtctagggctctgcttcctgtagacacgcacacgttgtctccatccaatggccttttctgaagttacagaaaacaccaacatgggagggagtttatgaagcaaaggcaaaggcaacacgtcggctagcttcagggtagcaccgtgagaaatgggctgtattgatactgtgaatgtttgttttccaagctgttttatacaggtttgttttttcatggtgtagggtatttatgacaaagtaaatgttgtgaaggttaaagataaattaagattatccaccaaatgctaaaaatactgatgtgtaaatcacctttatcgcctcacctcttctacaagcttttgtggcttgagggcttttgtttttggcttttgtctggatgaaagttttgcccagttgtgttttaaaaacaattcctcatgaacactaagattaattgtgtctgtatctctggaactgggtgctcatgttggttttaatgagcttgcaacccttccccgtttgctttgtttaaggaggtgcctctgttctttgtggaggagtgaaatggagctttaagtgtgtgtgtgtgttatgtgtgtttgcacacacgcgtgtgttattgtagcaataacaaaaagtagccatctccttgttccagctgaaaacctgctgtgagagttttgacagagcactttattttcgtcaagtttcaagtctgagttcaaaaccagccctgatcccttatgaccaactgctactcgaccagtcgccactcagtggccacctggtgcccgtttagatttttgcttgggttttactggccacctctatagacgagagttgcaaagttgctttgagcagagagggaaagattaatttacactgctggccaccgaaggcaggtgtttcctgggtagtaatctcacggctcttgatctggaaacttcagagtacaaattggtggatggtggaaggcaggacacgtatctctgtctgacggaaaacagacctcggggctggcgtaaaccctgctgccaggccctctccccactgccccaaaccggcctagacacgaagaccaaagcagcctgcacagggcaaggcccccgcggaatcctgcagagcaaactcaggttaacttgggtccatgaccgtttgcattcgaaacacaatacactgcctcgttctctcagttagcagctgggcagcagcgcaccattcatcatttaggcttgtggtttgttgtttactctaccaatgttatgtcgaaactgcattgtaaaaagagaagaaagtggcaggttttccaggtccacggaaaggtttggcctgacgctggagtgcggtgatgaacttacgtgacaatgattgtattcctcagtagcactttaaacgccgaagacagccctgcagcaagcctgcacacgggcttgggtgggttcctttggagaagatgtggctggaacacaaacaatctttgaaagaaataaatgtgcacacagaacacta

SEQ ID NO: 112680 - DNA, 6283 bp, Homo sapiens
  Payload ID: 2048
  Gene Symbol: C2CD3
  Gene Name: C2 calcium-dependent domain containing 3
  Uniprot ID: Q4AC94
  ENST ID: ENST00000313663
  CDS Start-End: 228-6119
aaagcgtcctgggtattgtagtgtattggagggaaggcgtcttggcgccttctcttcgcaccgttttccggagactgttagaggaagagtcgctttttcctgcctcccaggctgcccagcggcgccggttgccggggaacgcaggcgccgtggggagggatggcgggaggatactgcttaggtgctggagacggagttgagctggtgaagaagagctcgggctcatcatgaaacaacgaaaaggccaagggtctgggggcagccgtgggcgcaaaaaaagaggtttaagtgacatttctccatctacaagcctgccacctctggttgaaggccagctacgctgttttctaaaacttactgttaatagagtcatatggaagattgcaaagcctcccacttgtgtacttgtccgagtgagatggtggggagaaacatcagatggaaccctcttttgtcccagggatgcattgcagactgaaccaaaagctgtgagaacaactacacgttacgctattcgttgtggtccaaaacagtttacctcttatctaacagatatggctgtgctggtgctggaagtaatcaccaaacttgatggtcttccaattggtagagttcagatcaatggactagctcaactttctccaacccatcaaatcaatggattttttaccattgtttcatcaacgtctaagaaacttggagaactccaggtctcacttgccctggaacctctgtcagaaacttacgacagctaccatccacttcctaccactgacatgacagaaaatgtgcttttatctaagcagggattcagagagaatactgaacccagcagtacccagtttcaggttccatcaaggcctcgcgacatacataccatcaaaattgatggaaaagagttagcagccaacagcagtagatcaaccactccgaggggaaaagaccatgtatgctttgcagagaaccctgatacaataaaggattcttcctttggactacagcacagtcttaattcaggacagagtttagagtctgtaactctgaaaggcagagctccacggaagcagatgtcccttctgaacagttctgaattccagcctcaaattagaacagttgccaagagtcacagtgactcatgcattctttcttcaaacaacctccctaccaaggatcttctttcagctctgttagaacaaggcaataaactgcgtaatgccatggtgatttctgcaatgaaatcaagcccagagaccagcatgttgttggaccaagttcatcctcctattaatgaagattctcttagagcatcaacacagatcagagccttttctaggaatcggtttaaagaccacattgaagatcacctcctcccttcaactgagaatacattttggagacatgacacaaaagctgataccagagctatacagctgctattaggcagtgctgaattatcccaaggcaatttctgggatgggctaggctctcctccagattccccatctcctgggagtgatgtgtattgcatcagtgagctgaatgaccctcagtatgaccagagtcttctggagaatttattttatacagcacctaaatctgataccagcatcagtgatttcctcagtgaagaggatgatatcgtcccttctaaaaaaataagccagtcaacagctcttgccagatcatctaaggttctggagtcaagtgatcataagctgaagaagaggtcagcaggcaagagaaatagaaatttggttgaacaacagatgctctcagaaactccagaagatgcccaaacgatgacactaagtgtggatagactggcccttttgggtagaacacattcagtcagaatcatcatcgaaaccatgggagttcctccagatagtcctcagatgacccctggcaaaaaaagctatgctggtccaccacctaaggtgactacagcaaaaaagcgcactttctttgtagaatatcactttcctgtgggcttttcggaaagcggattgggaaagacagctttgatcactgaggttgttcgactcgcctccagtaaaattacagatggaaaggtgaagttccagcagcgatttgtgtttccagtacagtttggtggcccaatgatagagcactggtggaattccaacctcactttccaaatttatgtaaagaaaactccacagaaaaagccagaagtcattggatctgtgtcactttctttgcgagctgtcattcaatcagagctgctttctttcagtgatcagcttccagtgcaacaagaaaatggtcagtctccatttggccccctcaaggtaaccatggagcttattacagataacaaagatttcactggtatcaatactaagttaagtggcaacacccattataccccactttgtgctcctacaagtccaaataaggcactaccagaacttaaccaagatatgacctgtaccaaaaatccacaaaacttaaaccaaattcatgaggaaactgcaaagaaagcacagaacttggtgctccccaaccgaaagtcaccaagccctgtagcaccacatccttcaaccttcgtagctacgccagcctcccataatttagtcaatcagacaaatgggacaacaaaagagagtgctttgctgttgcatgtgctgttgatggtgccagatgggaaagattttattagtggagaatctgagaaacaatcaccatgcaatgtttatttaaattgtaaactcttcagcacagaggaagtcaccagatctgtcatcgcatggggcacaacacaaccggtctttaacttttctcaggtgattcctgtctctctgtcttccaaatacctggaaaggcttaagaacaatgtgatggtaattgaaacttggaataaggtgcggagcccaggacaggacaagctgctcgggctggtgaaacttcccctccaccagttttacatgtcattcaaagatgctaagatttctcgcctgctgctggatgcccagtacccagttgttgctgtcgacagctacatgcctgtgattgatgtgttttcaggccaccaaaatgggagtcttcgagtctttttagctatgggttcttcaaatcaaataatggcactacaaagattaaagaatgaagaaggaacactccctcccttcagccctaggccagcccatttcctggaccagccaactgcagcatctgttgctatggcagaggaccgaggaaatggactgatggagcactgctttgagatccatatagagatggttaaagggctagcccctcttcaggcaacagtctggggagaagcagattgttatgtccagtactactttccagttcaacactctcaatccagtgtgctgaaaggacctgagttccttgaaaatggaattactctgaagcccttcagaactgcaaccacactctgtgttccagatcccatctttaatagtgaacaccatcactctctcctgttgccagctgaggttccagtgcaaaggctcctactaagtgctttctctgcacagggcctcgtgcctggaggtggagtccagtttgaaatctggtgcagatactattatcctaatgtgagagaccagaaggtcgccaaaggaaccttgccattatcaaggatctgtgctatggtaaccacccagcatcgtgaggatgtgggaatacagacctttaatctccctttaacccccaggattgagaacaggaaagaattgaggaaccagtcatcaggtttactggatgtgggcctaaggtacaggcgtagtccaagaacagcagagggagttcttgctgcccgaactgtttccatctcagtccagattatcagagcctgtggtctgcaagcagcagccaaggctttggctgaacgggaacccgctctacagtttagtgccacagtcggggtcaatgcctctgtcaccactcatctctccttcctgccccagggagaacagcgccgaacccaccctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcatggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtagaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacaggtagttactgaagtaactggaagcatgaacatgcccaccaggactcccagctcccaacgattcctgagcatgagcagatagtctctgaaagcatttccacagatgtatccacaactatagattagattctggtcctctgatattagaataaagtactaaaaattgtaccgccttg

SEQ ID NO: 112681 - DNA, 7960 bp, Homo sapiens
  Payload ID: 2048
  Gene Symbol: C2CD3
  Gene Name: C2 calcium-dependent domain containing 3
  Uniprot ID: Q4AC94
  ENST ID: ENST00000334126
  CDS Start-End: 228-7289
aaagcgtcctgggtattgtagtgtattggagggaaggcgtcttggcgccttctcttcgcaccgttttccggagactgttagaggaagagtcgctttttcctgcctcccaggctgcccagcggcgccggttgccggggaacgcaggcgccgtggggagggatggcgggaggatactgcttaggtgctggagacggagttgagctggtgaagaagagctcgggctcatcatgaaacaacgaaaaggccaagggtctgggggcagccgtgggcgcaaaaaaagaggtttaagtgacatttctccatctacaagcctgccacctctggttgaaggccagctacgctgttttctaaaacttactgttaatagagtcatatggaagattgcaaagcctcccacttgtgtacttgtccgagtgagatggtggggagaaacatcagatggaaccctcttttgtcccagggatgcattgcagactgaaccaaaagctgtgagaacaactacacgttacgctattcgttgtggtccaaaacagtttacctcttatctaacagatatggctgtgctggtgctggaagtaatcaccaaacttgatggtcttccaattggtagagttcagatcaatggactagctcaactttctccaacccatcaaatcaatggattttttaccattgtttcatcaacgtctaagaaacttggagaactccaggtctcacttgccctggaacctctgtcagaaacttacgacagctaccatccacttcctaccactgacatgacagaaaatgtgcttttatctaagcagggattcagagagaatactgaacccagcagtacccagtttcaggttccatcaaggcctcgcgacatacataccatcaaaattgatggaaaagagttagcagccaacagcagtagatcaaccactccgaggggaaaagaccatgtatgctttgcagagaaccctgatacaataaaggattcttcctttggactacagcacagtcttaattcaggacagagtttagagtctgtaactctgaaaggcagagctccacggaagcagatgtcccttctgaacagttctgaattccagcctcaaattagaacagttgccaagagtcacagtgactcatgcattctttcttcaaacaacctccctaccaaggatcttctttcagctctgttagaacaaggcaataaactgcgtaatgccatggtgatttctgcaatgaaatcaagcccagagaccagcatgttgttggaccaagttcatcctcctattaatgaagattctcttagagcatcaacacagatcagagccttttctaggaatcggtttaaagaccacattgaagatcacctcctcccttcaactgagaatacattttggagacatgacacaaaagctgataccagagctatacagctgctattaggcagtgctgaattatcccaaggcaatttctgggatgggctaggctctcctccagattccccatctcctgggagtgatgtgtattgcatcagtgagctgaatgaccctcagtatgaccagagtcttctggagaatttattttatacagcacctaaatctgataccagcatcagtgatttcctcagtgaagaggatgatatcgtcccttctaaaaaaataagccagtcaacagctcttgccagatcatctaaggttctggagtcaagtgatcataagctgaagaagaggtcagcaggcaagagaaatagaaatttggttgaacaacagatgctctcagaaactccagaagatgcccaaacgatgacactaagtgtggatagactggcccttttgggtagaacacattcagtcagaatcatcatcgaaaccatgggagttcctccagatagtcctcagatgacccctggcaaaaaaagctatgctggtccaccacctaaggtgactacagcaaaaaagcgcactttctttgtagaatatcactttcctgtgggcttttcggaaagcggattgggaaagacagctttgatcactgaggttgttcgactcgcctccagtaaaattacagatggaaaggtgaagttccagcagcgatttgtgtttccagtacagtttggtggcccaatgatagagcactggtggaattccaacctcactttccaaatttatgtaaagaaaactccacagaaaaagccagaagtcattggatctgtgtcactttctttgcgagctgtcattcaatcagagctgctttctttcagtgatcagcttccagtgcaacaagaaaatggtcagtctccatttggccccctcaaggtaaccatggagcttattacagataacaaagatttcactggtatcaatactaagttaagtggcaacacccattataccccactttgtgctcctacaagtccaaataaggcactaccagaacttaaccaagatatgacctgtaccaaaaatccacaaaacttaaaccaaattcatgaggaaactgcaaagaaagcacagaacttggtgctccccaaccgaaagtcaccaagccctgtagcaccacatccttcaaccttcgtagctacgccagcctcccataatttagtcaatcagacaaatgggacaacaaaagagagtgctttgctgttgcatgtgctgttgatggtgccagatgggaaagattttattagtggagaatctgagaaacaatcaccatgcaatgtttatttaaattgtaaactcttcagcacagaggaagtcaccagatctgtcatcgcatggggcacaacacaaccggtctttaacttttctcaggtgattcctgtctctctgtcttccaaatacctggaaaggcttaagaacaatgtgatggtaattgaaacttggaataaggtgcggagcccaggacaggacaagctgctcgggctggtgaaacttcccctccaccagttttacatgtcattcaaagatgctaagatttctcgcctgctgctggatgcccagtacccagttgttgctgtcgacagctacatgcctgtgattgatgtgttttcaggccaccaaaatgggagtcttcgagtctttttagctatgggttcttcaaatcaaataatggcactacaaagattaaagaatgaagaaggaacactccctcccttcagccctaggccagcccatttcctggaccagccaactgcagcatctgttgctatggcagaggaccgaggaaatggactgatggagcactgctttgagatccatatagagatggttaaagggctagcccctcttcaggcaacagtctggggagaagcagattgttatgtccagtactactttccagttcaacactctcaatccagtgtgctgaaaggacctgagttccttgaaaatggaattactctgaagcccttcagaactgcaaccacactctgtgttccagatcccatctttaatagtgaacaccatcactctctcctgttgccagctgaggttccagtgcaaaggctcctactaagtgctttctctgcacagggcctcgtgcctggaggtggagtccagtttgaaatctggtgcagatactattatcctaatgtgagagaccagaaggtcgccaaaggaaccttgccattatcaaggatctgtgctatggtaaccacccagcatcgtgaggatgtgggaatacagacctttaatctccctttaacccccaggattgagaacaggaaagaattgaggaaccagtcatcaggtttactggatgtgggcctaaggtacaggcgtagtccaagaacagcagagggagttcttgctgcccgaactgtttccatctcagtccagattatcagagcctgtggtctgcaagcagcagccaaggctttggctgaacgggaacccgctctacagtttagtgccacagtcggggtcaatgcctctgtcaccactcatctctccttcctgccccagggagaacagcgccgaacccaccctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcatggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtagaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacagatctgcagactatcaccagggattcgcaagcagctttgagttctcaccgagccaggagtagaagcaacaaggccaccaccctcccagatgctcaggacacagaagcactgcaagaacgatgcacaatgccagatgagccattggtaagagctccagataaaggcacagattccccatcaccccctcctctcgaagagacttcaaatggaggaagaatgctccatgagtccctgaggcatgcagtacccattacaaggatgcagagcagtgaagacactgaggcaggcccagcctacagtgatgaggactatgaagaagacatcattgagcccaggaccttaaatgagatcaccacggtgacagacaaaactagcccttggtctagtgtcatatcagacacaagtgaggtcatcagccctcagcctgacgaggtgcagagggaaggcccctcttgtccttctccagggcctttctgcagagaggagcttatggtcaaaagtagctttctctccagcccagaaagggctgtcaacccccacctgcctaggcagggttctcctagccaaagtcttgttgcttgtgagtgtgaggcctctaaggccagggttggtggcgagtctgcctcagccaaccctcagcccatcccatgcccaacactctcaggagctcaacagagcagcacgtttgttggatggagctcaccacagacagatcagaacaaggagcccaagtcagaggccccagctgagaatgaagctgccaccagtgagctcggtgactctgctgatagcttcaagaagttgccgctaaatctagcctcccagagcagaagggaaaaccataagggaccacccatcgactcctctgacatcaggcagaggcaggtgacaactggatcagagacgtccacaaagcagagcctcctgctcccagggcccattgtggtgcccaacttctttttgcctccccagcagttggaggcttccctgcggatgctttcactctcagcaactttgccaccagcagccacaacagatcaggacaagagcgaagccaccaggggagctctctcccaaaggccttgtcgccccagacctaactcgctccccctcaacctgcctgaggaagaaactctcaggattgcacggatattttcttctcagtactcccagaaagactgacgcagcctgaggggctggggggaaggagacacctgcccaccctccgtcagctttgtccagcttgcaggaggcaccaggtctggctccttcagggctgtcacagtcctgaaaccaccacttgcctaggccacggatgcctcaagagacccggtcagcccagactggaggagtgccccaaaccagtccagtgtccacttgccagaatttcagctccttttttctgtggtgaggcaaaggctagaaataaaatggaatccgcgcccaagtgggacccaagcaggcatctttcggtggagaaacgccccccagtgtccttgacacagctgactgctggcatgagcccaccctctgcctgaagatgcaggaccatttttgccttaaaagttggggaggagggacatgtagattgtgtgcattgtgcatagtcaaggaaatcctagggccacctccagttcatttgtgtgggaacaaggatattttatagatacaaattatttttatgctgtgttgaattaatcaattaggagaggaaggggaaatcacttccttcaaactttttatctgattgtctaaaattctaaccatgcttttaacttattatttttacccagctctgaaggtcattgttcttgcctgtgtttgaataaaatcatattggtgtttgtaatctg

SEQ ID NO: 112682 - DNA, 2431 bp, Homo sapiens
  Payload ID: 2048
  Gene Symbol: C2CD3
  Gene Name: C2 calcium-dependent domain containing 3
  ENST ID: ENST00000414160
  CDS Start-End: 1-2331
gctgcccgaactgtttccatctcagtccagattatcagagcctgtggtctgcaagcagcagccaaggctttggctgaacgggaacccgctctacagtttagtgccacagtcggggtcaatgcctctgtcaccactcatctctccttcctgccccagggagaacagcgccgaacccaccctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcatggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtagaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcaggaagaatctgagtgagcttgatcagattcagaggtacttccgccagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacaggactcccagctcccaacgattcctgagcatgagcagatagtctctgaaagcatttccacagatgtatccacaactatagattagattctggtcctctgatattagaataaagtactaaaaattgta

SEQ ID NO: 112683 - DNA, 3951 bp, Homo sapiens
  Payload ID: 2048
  Gene Symbol: C2CD3
  Gene Name: C2 calcium-dependent domain containing 3
  ENST ID: ENST00000442398
  CDS Start-End: 1-2034
ggagaacagcgccgaacccaccctgtggcctgttctttctgccctgagttctcccatcacgttgagttcacatgtaacttggtgactcagcactgtagtggagaggcctgtttcctagcagagttgttggagtttgcagaagttatttttgctgtctatcatgaaaataccaagtcagcaagtgatataatcagtattgagtcatgcaaagagtatctgcttggagtagtaaaagttccaacaaaagagctgctgatcaagagatctgggatcacaggatggtatcctatcattttaccagaagacgggggcctacctcatggcctggagctcatgcagaagatcgtgggtggtctggagctttcgatttccttcacgcatcgtggagatagagaacgggtgttggaagctgctgagcatttgggctggagctttgagaacagcctgaaagattttgtcagaatggatgaaggggagccagccactgtcaccatctccaccccaaggctgtggctgcccatccattgtgtgctgcttgctggccacaaccacattcataagaatacatattgctaccttcgctacaagttctatgatcatgaagccttttggacccctctcaagaagcctaaggaatctgtaaacaaaaagcagattatggtcactttcaaggcatccaaaagagcagaagtcaccaggggcccatcactgctttggtacttcagggaggagaggctagagatccaagtgtggcgagcttatggcaatgacagtgtggagagaccccatcagacagacagctggattggctcagcctatgtggacctggccagacttggggagaggtcagcgaggacgctaactgtcagtggtgtgtatcctctgtttggacgaaatgcttccaacctctcaggagctgccttgcgagttcatgtggttctttcctctctttcctcacaccttgagcccactcatgagctggactccatggactgcagcagccacagtgagtctgagcagctccccagaaggaatgatgaggtccagctctctccaccagaagtcatctcctgccaccagaagtctcctgcctccacccaggtcccctgcagcagcaccacagctgaagtccgcctgacgcaggagggccctgctgatttggatggaacgtttgcagtcagcatcctagtagaaagagcaatgcacttgagcttgaaagggagccccttgacagagcggaaagtatcgatacccagttgttgtgtatcctttgcaacagccgatgagtcatctcctgtatacacccaagtggttgaaaacacagattcccccatctggaattttcaacagcagtcaaggctatcaaaagagctgcttctggacccacaacaaaccctggtcttcaaagtttggcataaaggagatgaggagagggtgattggctttgcctcggtggacctctccccacttctctctggcttccagtttgtctgtggctggtacaacatcacagacttcagtggagagtgccaggggcagataaaagttgctgtctcccctttggagagtttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcagaagctcaccaagcctttcctacccctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacagatctgcagactatcaccagggattcgcaagcagctttgagttctcaccgagccaggagtagaagcaacaaggccaccaccctcccagatgctcaggacacagaagcactgcaagaacgatgcacaatgccagatgagccattggtaagagctccagataaaggcacagattccccatcaccccctcctctcgaagagacttcaaatggaggaagaatgctccatgagtccctgaggcatgcagtacccattacaaggatgcagagcagtgaagacactgaggcaggcccagcctacagtgatgaggactatgaagaagacatcattgagcccaggaccttaaatgagatcaccacggtgacagacaaaactagcccttggtctagtgtcatatcagacacaagtgaggtcatcagccctcagcctgacgaggtgcagagggaaggcccctcttgtccttctccagggcctttctgcagagaggagcttatggtcaaaagtagctttctctccagcccagaaagggctgtcaacccccacctgcctaggcagggttctcctagccaaagtcttgttgcttgtgagtgtgaggcctctaaggccagggttggtggcgagtctgcctcagccaaccctcagcccatcccatgcccaacactctcaggagctcaacagagcagcacgtttgttggatggagctcaccacagacagatcagaacaaggagcccaagtcagaggccccagctgagaatgaagctgccaccagtgagctcggtgactctgctgatagcttcaagaagttgccgctaaatctagcctcccagagcagaagggaaaaccataagggaccacccatcgactcctctgacatcaggcagaggcaggtgacaactggatcagagacgtccacaaagcagagcctcctgctcccagggcccattgtggtgcccaacttctttttgcctccccagcagttggaggcttccctgcggatgctttcactctcagcaactttgccaccagcagccacaacagatcaggacaagagcgaagccaccaggggagctctctcccaaaggccttgtcgccccagacctaactcgctccccctcaacctgcctgaggaagaaactctcaggattgcacggatattttcttctcagtactcccagaaagactgacgcagcctgaggggctggggggaaggagacacctgcccaccctccgtcagctttgtccagcttgcaggaggcaccaggtctggctccttcagggctgtcacagtcctgaaaccaccacttgcctaggccacggatgcctcaagagacccggtcagcccagactggaggagtgccccaaaccagtccagtgtccacttgccagaatttcagctccttttttctgtggtgaggcaaaggctagaaataaaatggaatccgcgcccaagtgggacccaagcaggcatctttcggtggagaaacgccccccagtgtccttgacacagctgactgctggcatgagcccaccctctgcctgaagatgcaggaccatttttgccttaaaagttggggaggagggacatgtagattgtgtgcattgtgcatagtcaaggaaatcctagggccacctccagttcatttgtgtgggaacaaggatattttatagatacaaattatttttatgctgtgttgaattaatcaattaggagaggaaggggaaatcacttccttcaaactttttatctgattgtctaaaattctaaccatgcttttaacttattatttttacccagctctgaaggtcattgttcttgcctgtgtttgaataaaatcatattggtgtttgtaa

SEQ ID NO: 112684 - DNA, 574 bp, Homo sapiens
  Payload ID: 2048
  Gene Symbol: C2CD3
  Gene Name: C2 calcium-dependent domain containing 3
  ENST ID: ENST00000535954
  CDS Start-End: 1-574
tacaaaggaagctgggtaacagagtatgagaactccgcagactcccggctgggaacccgacgactttcaccggaaggaggagcgctcttcagggcaatgcaccctgcgcaatggagtccacaaagggcgcatccctatgcgcttgcgcagctggaggcgccccccagccaaccccggagaggtttaagtgacatttctccatctacaagcctgccacctctggttgaaggccagctacgctgttttctaaaacttactgttaatagagtcatatggaagattgcaaagcctcccacttgtgtacttgtccgagtgagatggtggggagaaacatcagatggaaccctcttttgtcccagggatgcattgcagactgaaccaaaagctgtgagaacaactacacgttacgctattcgttgtggtccaaaacagtttacctcttatctaacagatatggctgtgctggtgctggaagtaatcaccaaacttgatggtcttccaattggtagagttcagatcaatggactagctcaactttctccaacccatcaaatcaatggattttttaccattg

SEQ ID NO: 112685 - DNA, 863 bp, Homo sapiens
  Payload ID: 2048
  Gene Symbol: C2CD3
  Gene Name: C2 calcium-dependent domain containing 3
  ENST ID: ENST00000538361
  CDS Start-End: 1-514
tttgatacacttcaaagaagaaaggcaagcaaggcgtggagtggagacctcaaaatcactgatcccaatatacagtcccttttccttccctgcctctgatacgtatgctgcattctccagccacatggcaaggcagaccctagaccaacttgctcatgcctcctcaaaggagcttgatttctcctctcctgggagaagtgataccacaagaagccaagcatcacgccatgaagagcatgtgcagaacattcgccggtttcatgaatccctgcatcttcagggagaggcacccttgccatgtgatgacaaactgaccacatcacctttgtcctcccaaacctccattctgacttctctcagccctcagactcaaacggccatctcacagcaccaggagagctgtagggaccatcttgggccaggtgccagcagcctagaccctgggagccagtgtatcctggagaaatccagtaacctggtgttgcaagtcagctccttaatcacagatacctaacctgttggtatccatggcctcagataaatgctctgtgtttgacttccacttgcttggatattttcagtcaagtgtttattgagcaccatctgtgccaggcactattctgttatttgtcccaggaagatacagtggtggatatgacaggcattatctcccttcatcaagcttatattctatagtcaaccaaagaaaaatcctctcacaaagaaagtatgacagcaaaacagatgaaggcttgtttggagtagaggtggaaacaaataggggaatctttctaaaggggcatattaaaagaggagagagaagggaattgtggccaggcacggtggctcacacctgtaatccc

SEQ ID NO: 112686 - DNA, 2722 bp, Homo sapiens
  Payload ID: 2048
  Gene Symbol: C2CD3
  Gene Name: C2 calcium-dependent domain containing 3
  ENST ID: ENST00000539061
  CDS Start-End: 193-1713
ggcgtcttggcgccttctcttcgcaccgttttccggagactgttagaggaagagtcgctttttcctgcctcccaggctgcccagcggcgccggttgccggggaacgcaggcgccgtggggagggatggcgggaggatactgcttaggtgctggagacggagttgagctggtgaagaagagctcgggctcatcatgaaacaacgaaaaggccaagggtctgggggcagccgtgggcgcaaaaaaagaggtttaagtgacatttctccatctacaagcctgccacctctggttgaaggccagctacgctgttttctaaaacttactgttaatagagtcatatggaagattgcaaagcctcccacttgtgtacttgtccgagtgagatggtggggagaaacatcagatggaaccctcttttgtcccagggatgcattgcagactgaaccaaaagctgtgagaacaactacacgttacgctattcgttgtggtccaaaacagtttacctcttatctaacagatatggctgtgctggtgctggaagtaatcaccaaacttgatggtcttccaattggtagagttcagatcaatggactagctcaactttctccaacccatcaaatcaatggattttttaccattgtttcatcaacgtctaagaaacttggagaactccaggtctcacttgccctggaacctctgtcagaaacttacgacagctaccatccacttcctaccactgacatgacagaaaatgtgcttttatctaagcagggattcagagagaatactgaacccagcagtacccagtttcaggttccatcaaggcctcgcgacatacataccatcaaaattgatggaaaagagttagcagccaacagcagtagatcaaccactccgaggggaaaagaccatgtatgctttgcagagaaccctgatacaataaaggattcttcctttggactacagcacagtcttaattcaggacagagtttagagtctgtaactctgaaaggcagagctccacggaagcagatgtcccttctgaacagttctgaattccagcctcaaattagaacagttgccaagagtcacagtgactcatgcattctttcttcaaacaacctccctaccaaggatcttctttcagctctgttagaacaaggcaataaactgcgtaatgccatggtgatttctgcaatgaaatcaagcccagagaccagcatgttgttggaccaagttcatcctcctattaatgaagattctcttagagcatcaacacagatcagagccttttctaggaatcggtttaaagaccacattgaagatcacctcctcccttcaactgagaatacattttggagacatgacacaaaagctgataccagagctatacagctgctattaggcagcctcggcctcacgaggtgccgggattgcagacggagtctcgttcacgcagtgctcaatggtgcccaggctggagtgcagtggcgtgatatcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggatcccctctgcctggctgcccagtctggaaagtgaggagcgtctctgcccgcccgccatcccatctaggaagtgaggagcgcctcttcccggccgccatcccatctaggaagtgaggagtgtctctgcccggccacccatcgtctgagatgtggggagcgcctctgccccgccgccccgtctgggatgtgaggagcgcctctgcccggccgcgaccccgtctgggaggtgaggaccgtctctgcccagccgccccgtctgagaaatgaggagacctctgcccggcagccaccccatctgagaagtgaggagcccctccgcccagcagccgccccgtctgagaagtgaggagcccctccgcccagcagccaccccgtctgggaagtgaggagcgtctccgcccggcagccaccccgtcccggagggaggtgaggggtcagctccccgcccggccagccgccccgtccgggaggtgaggggcgcctctgcccggccgcccctactgggaagtgaggagcccctctgcccggccaccaccctgtctgggaggtgtacccaacagctcattgagaacgggccatgatgacaatggcggttttgtggaataggaaagggggaaaggtggggaaaagattgagaaatcggatggttgctgtgtctgtgtagaaagaagtagacatgggagacttttcattttgttctgtactacgaaaaattcttctgccttgggatcctgttgatctatgaccttatccccaaccctgtgctctctgaaacatgtgctgtgtccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaataaataaataaataaataaataaaatgta

SEQ ID NO: 112687 - DNA, 3445 bp, Homo sapiens
  Payload ID: 2049
  Gene Symbol: C2CD4A
  Gene Name: C2 calcium-dependent domain containing 4A
  Uniprot ID: Q8NCU7
  ENST ID: ENST00000355522
  CDS Start-End: 142-1251
actggtgctgaaccccgccgcgcgcgctttgaatttcccagccgctaagcgcctctcctggtcggtgtcccaggcagaaaggtgcagagacccatctgacgcaggactccaggtagacaagctccagcagagagtggccagatgtggtgcctggagcgactccgcttgggtcctgagtgccttcggcggagcggagactggcttctcccgggtcgggcccgcggagccaagtctcgcaccaccgccgcgtgcgcaaatgtgctcactccggaccgcatccctgagttctgcatcccgccacggctcatgccccgcctggccttggctgcgctccggaattcttgggtcgaagaagcagggatggacgagggcgccggccgcacagactgggacccgcgctcgcaggccgcgctgtcactgccgcacctgccccgtgtgcgcaccgcctacggcttctgcgcgctgctcgagagcccgcacacgcgccgcaaggagtcgctcctgctcgggggcccgcccgcgccccggccccgggcccacacctacggcggcggcggcggcccggacgccctcctggggaccctgcgcgtcccgcgagctccgggcccggcgacccccgcggcccccggctgtccccgcccgccccaggacgcgctcgcccggcggccccgcggctgccgcctcctgcgcgtccccgacgggctgctgagtcgcgcgctgcgggctgggaggagtcgccgcctgacccgcgtccgctccgtctccagcgggaacgaggacaaggagcgccgcgcgggctcccagtccccggcccgggccccctccacgagcccgccgtcgtcccgggtcccgtttcccgagcgcctggaggccgagggcaccgtggctctgggccgcgccggcgacgccctgcgcctggccgccgagtactgtccgggaaccgggcggctccgcctccggctgctccgcgccgagagcccggccggaggcgcccccgggccccgagccgtcagctgtcgcctcagcctcgtcctgcggccgccgggcaccgcgcttcggcaatgcagcactgtggtggggcgcagccgcaaggcctcctttgaccaggacttctgcttcgacggcctctcggaggacgaagtgcgccgcctggccgttcgagtcaaggcccgggacgagggccgcggccgggagcggggccgcctgctgggccagggtgagctgtccctgggcgccctcctgctgctctgagggcccagccctccccggggcgctctgcccgggggactccggacactgacagccgcgtggtacaaaataaacgtgtatttgttgttcttatcagtcccgtttcagtacaacactggcagagatgattctagattaactatcccagtaaaagatatgatattttccatagatacctccagaatttttttcagcaaatggaatggttctacagtgtttcccaatatagacagccatttgcataccatatgtaccacacacgcctaggaaataatgaatcacatgaagtgttagaactagaaagtgtcttggcgatctgtttgctccaatcacctcattttaaaattggtgctttccacaacatgcatggagaccatcttggagcatttacttttgaagcattttgtttaagaccccggataagaaaatgagggcaaaagaggtgaagtgacttgtccaagatcaacagtgaattattagttggaacgccagcctgatactcctagctatatctcactggaaaagcattggagaaaatgaaaccattttaatattctaagcttaaataatagttataataggctaggtgtggcggctcacgcctgtaatcctggcactttgggaggccgaggcgggcagatggcttgagcccaggaatttgagaccaggctgggcaacatgggaagaccgcgtctccataaaaaatacaaaatttagccggacgtggtggcacgcacctgtagttccagctactctggggctgaggcgcaaggatcacttgagcctgggaggtcaaggctgcagtgagccgagatcgtgccactgcactccaacctgggcaaccggagtgagaccctgtctgcaaataataataataataataaatagttttacaagcgttaatttatgttttaacccccaaaaggaggcactgctatgcccattttacagatgaggatattgaggcacagaataaagagcagagccagaatttgaacctagacaatcagcatttcactcattactcttatgtaggtaataccacagtgtctaaagggctcgctattaaagttgcgagtattgtgcaacttctctctgaaactgttgacactgaagttcgtgtctacttgtattcctcatcctgcttttggtgaaaaaacaaattgcttgaaatgaataatttattatctcatgctaataacttcaggcattgagatgagctgatgggtctaaagctctgaggaggaagctaaccggcctcagaatcatagaaatgggtgccagccttgttgtaaccaggtgagtttatctgctggaacaggcagtggagagtgtacagatagcatggttttacctctggcttctgataataattccagatttaacaatcctgttttagaggacgattttccctcatcccttgaattcactgccagcagggcatttttttcttttttttatgcaaataggaaaatgcatcctaaatgagggtttaaaaaattgaaaatatttaaatatacaggatggtgttaaatatgactccattatcaatctggattcagaaatggtttctgctttattttatttcattttatcttttagaaacaaggcgtcactctgtcacccaggctggagtgcagtggtgtgatcatagctcactgcagcctctacctcctgacacaagctgtcatcccgctttggcttctcaaagtgctaggattataggcgtgagccaccatgcccgaccagtttctgcttttattaaaattgttcacagttttatacattcatgttcattaaaaatgctatttagaaaagagtttgataaaataaatattatacaaaattcgaagaaaaaagaaaagagtttctgtttcagtcacaaattagggttattgtgatgtgtatttatgatgaccattgaacaaatgtgaagaatactgtgaattctatgactttatcaaaatcagccacatccaggagcttgcagttgttgaccaaatgaatgatgacatagagtagttcagatctatcatgtgctcttctatctaatcagtcaatatttccttggccctcaagccaacattcattttttatgtataaccttcttcatgattttgaaattttgatagggtaactgctaatgagttcacaaatgtagcactttaaaaggaaaataaatggagagtgaaaacaa

SEQ ID NO: 112688 - DNA, 1579 bp, Homo sapiens
  Payload ID: 2050
  Gene Symbol: C2CD4B
  Gene Name: C2 calcium-dependent domain containing 4B
  Uniprot ID: A6NLJ0
  ENST ID: ENST00000380392
  CDS Start-End: 130-1224
agtactgaaggtggcgcctcggcagcgggctagaggccactggcactgagcttgcaaccagatccagagacactgaagaagagagaaaggcgcacctcttcccgccactcctagccccagcctccaaggatgcggctcctcgagaaactctgttcctcggccgcaggcagctccgcgccgaagcccgccttcgccaaagtgctcacgccgaatcgcatccccgaattctgcatcccgccgcggctgccggccccttgcacgctcgagtctccaatccgggccgccgccgtgccccggcgctgcgccgctgaaagcgacctgtggccccgcgcggcagacgaggacgccggccgcacggactgggacccgcgctcgcaggcagcgctgtcactgccgcacctgccccgtgtgcgcaccacctacggcttctgcgcgctgctcgagagcccgcacacgcgccgcaaggagtcgctcctgctcgggggcccgcccgcgccccggccccgggcccacagctgcggcggcggcggaggcccggacgcccccctggggaccctgtgcggcccgcgaggtccgggcccggccacccccgcggcccccggcggtccccgcctgccccaggacgcgctcgctgcggggccccgccgctgccgcctcctgcgcgtccccgacgggctgctgagtcgcgcgctgcgggctggaaggagtcgccgcctggcccgcgtccgctccgtctccagcgggaacgaggacgaggagcgccgcgcgggatccgagtccccggcccgggccccctcctcgagcccgctgtcatccagggccccgcttcctgagcgcctggaggccaagggcaccgtggctctgggccgcgccggcgacgccctgcgcctggctgctgagtactgtccgggaacccggcgtctccgcctccggctgctccgcgcggagagcctgttcggaggcgcccccgggccccgcgccgtccgctgccgcctcagcctcgtcctgcggccgccgggcactgcgcgttggcaatgcagcgctgtggtggggcgcagccgcaaggcctcctttgaccaggacttttgcttcgacggcctctcggaagacgaggtgcgccgcctggccgttcgcgtcaaggcccgggatgagggtcgcggccgggatcggggccgcctgctgggccagggtgagctgtccctgggcgccctcctgctgctctgagggcccagccctccccggggcgctctgccctggagactccggacactgacagccgcgtggtacagaataaacgttatttatttttttatttatgatactgctttattgacgttttacttcctcaccatccacatttgtcatcgtctattggtaaagaagaaaaagataatgactccctgttctgttcacaggacccccatatctctttccagaccatttttgcattccaaggaaaaatgggttggcttgggactgggagagaaaggaagtacacccatctgcattgtttttaattccttccggttttctatcaatgttacagtttttttttaataaagcaagttattcattcaga

SEQ ID NO: 112689 - DNA, 3129 bp, Homo sapiens
  Payload ID: 2051
  Gene Symbol: C2CD4C
  Gene Name: C2 calcium-dependent domain containing 4C
  Uniprot ID: Q8TF44
  ENST ID: ENST00000332235
  CDS Start-End: 206-1471
gcggtttcccgccgcgggtgaatgagtccgactgcgctgccgccgccgccgccgcccgcatcgaagctccggccgcgtcccccgcgccagccccgggagcctgcgcgccgagacccctgcgtgtctgcgaacagacctccggcctcgggccatcaccccgggcagacgctgcagcccctgtccgggcctcttgcctgccgcccccatgagaaaaaccaacatgtggttcttggagcggcttcgggggtctggggaaaacggtgctgcccggggcgtggggagtgaggcgggggacaaggcctccaaggggcccctgtacagcaatgtgttgacgcccgacaagatccccgactttttcatcccccccaagctgccctcgggccccgcggagggcgagggacaggccgcgctgggcccctccacgtcggaacagaacctggcctctgcggccccccgccagaccccacggagcccccggctgcctgccaagctggcagccgagagcaagagcctgctgaaggcagccacccggcacgtgatccagatcgagagtgccgaggactggctgtccgaggaggccactgacgccgacccccaggcccagggtgccatgtccctgccctcggtgcccaaggcccagacgtcctacggcttcgccatgctggctgagagcccccacacgaggcgcaaggagtctctgttccacagtgagcacggggctctggcccaggtgggctccccaggggccgggcgccgccgggcagctgccaaggccaacgggggtgatgggggccccagggaggctggcggggccctcatgagccccggccgctacttcagtggcggggagagcgacacagggtcctcggccgagtcctcccccttcgggtcccctctgctgtcccgctccgtgtctctgctcaaaggtttcgcccaggacagccaggccaaggtgagccagctccggcactccgtgggccgccacggctccctgtctgcggacgacagcaccccggacgccagccccgggagccggcgccgcctgacccgccgggcacccccggaacctggccccgagtcgggccaggcgcgtggggagcacacggtccacgtgggccctcggggcagcgtgcggctgctggccgagtacgaggccggccaggcccgcctgcgggtgcacctgctggccgccgagggcctctacgaccgcctgtgcgacgcccgcagcatcaactgctgcgtgggcctgtgcctggtgccgggcaagctgcagaagcagcgcagcaccatcgtgaagaacagccgccgccccgtcttcaacgaggatttcttcttcgacggcctggggcccgccagcgtccggaaactggccctcaggatcaaggtggtgaacaagggcagcagcctcaagcgggacacgctgctcggggagaaggagctgcccctgacctccctgctccccttcctgtagagcggggacctgctcgctgtccgctcgggtgcagagggcagaccccggtctctcctccacaccgggtgctggcgggcgggtccgctggcttgggctggggctggccggggaggggctcacactcaggctgggctgggcgctgatgctgtagctgacgcagggtttcctgggtcacccgatgctgactggagtattatttttcatgaattaatttctcctttggaggaggaggaggaggaggagaggggcctcgggggaagagaaggggccacttcgcggggcagagggtccccctttgcccctccacactgcctcgcgcctttcacgcagagttctagaaggaggttctcaggggttcaggaatccgtgcatgtggccagggcggggccgtggacagggaggtgacaagtcttggagcccacagtctccttcactgcacgtgtgtcttcctcccccacagcctgccgccatccagttcccaccccgcggagagcagggcctcgcggccacaccaggcccaggctctgcccgggacgccccctcccaggggtcaggcttggctctgggagaccccagcttcccaggctccggtggggagtggggccaggcgagggtgccctgacgagggtgggcgcggagggagcagccgctgccacagtcggagcagaggaggtcttggcagaggtccgcggggaggagacggctctcctggcctgttttcctccaacactgtcgccgctggctttttgggtacaggcccgtctggccatttctgctgtggcgccggagggtcttgctcagagatgcccagagagcagccctatggcccatccgtcctcgctgggggctgccaccccgtcgcccttttgtccagcgtctgcagctgggagcgacacgcagtgattgacggccgtggctttgacgccacgtgtgtaaataggctgtggctacggtgggtgggtcggagcccaggaggcagctggggggacctggctatggcctttcctgctgttaggtggctgcaaggcttccattgtgtggttatgtgggtccttgaatgattttggggaggtttccagctcagaatgatgcagaaatgataagactcaaagcaggggccaggccaggccagtgccttcgcctctcccggctgctggtgggcacggaggaaccagggcacatctgtggtacccagggacgtcccttgtcagcccgtttgccacacattgttcctcttgtccaggggagggtggaggagctgcttcccaggactggaggagcagctgggcccctgctgcacgtccggtgggacacacctgtgagccctccagagggagagtgcaggccccttctgagcctggtgttgcagggctccgctctctcccggaagccagggcacccagggcggaggctcctcaggccggggaggcggggagggtgccctgcatggagagagacgccggcgctccccgccttctctgatgctcacccctcccaggccctgttctccctggggtcccccgtttagtagcccccctgcactctttgatatcttagtgtctgaggttgactgtgggtaaatctttaagacactccccagctgtgtttgtttataaatgctgtttatagtgcaataaaggtgtttcgggaatacgggg

SEQ ID NO: 112690 - DNA, 1757 bp, Homo sapiens
  Payload ID: 2052
  Gene Symbol: C2CD4D
  Gene Name: C2 calcium-dependent domain containing 4D
  Uniprot ID: B7Z1M9
  ENST ID: ENST00000454109
  CDS Start-End: 587-1648
agaataatgcagacaactgatcactgcaagtcactctgccttggagctattggaatggctccagaacagggcactgggggccaaggcaggatttcaaccaggagggttttacagaagatggacttcacctgtgagggctggggttggaaccgagcaccaaagaagtggccactgtccactgatggccgtctccctcttctctgtagccctcccccacccctaagcagcccagcttcagcagaggaggcctgggcacaggaatggattgttgctagaaacctggcttcagctggaggaagtcagaagaccgggctgatggccgcgcagacagagctgtgtttatccaggaaaagagccccccagactgcgccgccctttctttttctgctcaaataggggtccgcgctcccagtgggtccggagaccggggcgcggtggctgaccgcccggtgtacgccagcatcactcacctctgactcctctgcgctcctcgcccagccccgctccgccgagcactcccatctgagacgggatttggaccctctcggccctgcggaattcggaattccattaccccacccaccgcatgtggctcttggaaaaagctggctataaggtgggggccgcggagcctgcggcccgttgggcgccttccggcctgttctccaagcgtcgcgccccgggcccgcccacaagcgcctgccccaacgtcctcaccccggatcgcatcccgcagttcttcatcccgcctcggctcccggacccgggcggcgcagtgcccgcggcccggcggcacgtggcggggcgcggcctccccgcgacctgctcgctgcctcacctggcgggccgcgaaggctgggccttcctgcccgagagcccgcacacgcgccggcgggaatccctgttccacgggccgccacctgccccggccgggggactccccgcggcgcagtcccggctgcacgtctccgccccggacctgcgcctctgccgggcccccgacagcgacacggcctcgtcgccggactcgtcgcccttcggctccccgcggccaggcctgggccggcgccgggtgtccaggcctcactctctgtccccagaaaaagcgagctcggccgataccagcccgcactcgccgcgccgcgccgggccgcccacgccgccgctcttccacctggacttcctgtgctgccagctgcggcccacgcgcgagagcgtgctgcgcctggggccccgcggcgggcagctgcggctctccaccgaatatcaggccgggcccgggcggctgcggctgcgcctagtgagcgccgagggcctgccccggccgcggtcccgccccgggagcggcggcggcggctgctgtgtggtgctgaggctgcggccccgcgtccggccgcgggagcagcagagccgcgtggtcaagtgcagcgccaaccccatcttcaacgaggatttctttttcgacgggctcggccccccggacctggccgcccgcagcctgagagccaaggtgctagacaggggcgcgggacttcgcagggatgtgctgctgggggagtgcgagacgcccctcattgcgctgctgcccccgctgggtgggggactaggtcccgggtcatccctggcgcccacccatctcagcctgtagcctgagcccctggcttcctcaggacgtctccactgtgtctgcagtccacattctttccaccctgcccggcttgtatttatttttgctaataaaatgtccccttgtcctt

SEQ ID NO: 112691 - DNA, 4436 bp, Homo sapiens
  Payload ID: 2053
  Gene Symbol: C2CD5
  Gene Name: C2 calcium-dependent domain containing 5
  Uniprot ID: Q86YS7
  ENST ID: ENST00000333957
  CDS Start-End: 257-3259
gaacgatcgatgctttcttccgcgccccgagagccgccatttttgagagcgggggaggagagacaagcaggggcggcagaggctcaacgggatgctgactgggttttgcttttcgtcccagccttgtggggccgggacggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagattcccttcaatgaagatcccaatcccaatactcactcatcaggaccctcaacccctctgaaaaaccaaacttattccttttcaccttccaagtcctacagtcgacagtcctcttcttctgacacagatttgagtttgacacccaaaactggaatgggaagtggtagtgctggaaaagaaggggggccctttaaagctcttttaagacaacagactcaatcagcgttggaacagagggaatttccattttttaccttgacggcatttcctcctggattccttgtacacgttgggggtgtagttagtgcacgttctgtgaagcttttggatcgtatccacaatcctgatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgacccttcagtaagttaagataaatttttaaaagaaccgtagcaaagatggaacctttgtaatttatgttgattttaataaaatcataatttaaaaaatgaaatgggaagattgtcaggaaattaggatagctactctagtataatttagaaaaactaagcaagagattctccagttgctagtgagtaagcactctgatttgagaaatgtgtggggacaatggagaaaagttttcagaaaactgctatgtagatttctgaatgtgttgtattttgctgaggaattcggtaacaactgaaagggaaaagtgcttcagccatcttttgaaaacaagttaaaattctggaacttgtatctgtaatacatcctaactcttgtaaaagaaaataatttatcatagctggtgtcctttcattgaaagttgtaatactgtctctaaggagggaggaaaagattattatataattttataactggcaacatttgagttagtattgactttgtctaaaagaggcttgacttcaactgggataaaaatgtcagtgaattttgttaaagtagtaaaaatgcagttgacttagtaggaacataaaattatttcctaataagataatattgcactcctaccaaataaacaggattttagtaatatctgagggattgttgatggtgagttagactgtatttggcatagaatttggaaatgtaacttgaatgtaaatatgctgcaaaatgttgaatgtatacatagaaagactttttctgtcgacgccaaatgcccgttgtaaatgaaccttaaatattacattcctcctttgcacaataatatttctttataacacttatgattttttcccccaggacaacaaactgcccttaagagtcatttccttgttatcacaggtgtcaatatttttctgtattttgtttataattttattttttaaataaaaagtgtataaaaataaa

SEQ ID NO: 112692 - DNA, 3463 bp, Homo sapiens
  Payload ID: 2053
  Gene Symbol: C2CD5
  Gene Name: C2 calcium-dependent domain containing 5
  Uniprot ID: Q86YS7
  ENST ID: ENST00000396028
  CDS Start-End: 120-3248
cggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagtctccgctggttcatcctccaagccatggatgccgctcgactcacaacagcccaattcacactgctactggctcacgacttactcagaacttctctgtgtctgttcccactctcatctatactggaatgggaagtggtagtgctggaaaagaaggggggccctttaaagctcttttaagacaacagactcaatcagcgttggaacagagggaatttccattttttaccttgacggcatttcctcctggattccttgtacacgttgggggtgtagttagtgcacgttctgtgaagcttttggatcgtatccacaatcctgatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagcaacgtcagttgattacagttcctttgcagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgaccctt

SEQ ID NO: 112693 - DNA, 3490 bp, Homo sapiens
  Payload ID: 2053
  Gene Symbol: C2CD5
  Gene Name: C2 calcium-dependent domain containing 5
  Uniprot ID: Q86YS7
  ENST ID: ENST00000446597
  CDS Start-End: 120-3275
cggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagattcccttcaatgaagatcccaatcccaatactcactcatcaggaccctcaacccctctgaaaaaccaaacttattccttttcaccttccaagtcctacagtcgacagtcctcttcttctgacacagatttgagtttgacacccaaaactggaatgggaagtggtagtgctggaaaagaaggggggccctttaaagctcttttaagacaacagactcaatcagcgttggaacagagggaatttccattttttaccttgacggcatttcctcctggattccttgtacacgttgggggtgtagttagtgcacgttctgtgaagcttttggatcgtatccacaatcctgatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagcaacgtcagttgattacagttcctttgcagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgaccctt

SEQ ID NO: 112694 - DNA, 850 bp, Homo sapiens
  Payload ID: 2053
  Gene Symbol: C2CD5
  Gene Name: C2 calcium-dependent domain containing 5
  ENST ID: ENST00000539615
  CDS Start-End: 1-850
attggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctca

SEQ ID NO: 112695 - DNA, 791 bp, Homo sapiens
  Payload ID: 2053
  Gene Symbol: C2CD5
  Gene Name: C2 calcium-dependent domain containing 5
  ENST ID: ENST00000542683
  CDS Start-End: 1-497
taatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagattcccttcaatgaagatcccaatcccaatactcactcatcaggaccctcaacccctctgaaaaaccaaacttattccttttcaccttccaagtcctacagtcgacagtcctcttcttctgacacagatttgagtttgacacccaaaactggaatgggaagtggtagtgctggaaaagaaggggggccctttaaagctcttttaagacaacagactcaatcagcgttggaacagaggatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaa

SEQ ID NO: 112696 - DNA, 3496 bp, Homo sapiens
  Payload ID: 2053
  Gene Symbol: C2CD5
  Gene Name: C2 calcium-dependent domain containing 5
  Uniprot ID: Q86YS7
  ENST ID: ENST00000536386
  CDS Start-End: 120-3281
cggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagtctccgctggttcatcctccaagccatggatgccgctcgactcacaacagcccaattcacactgctactggctcacgacttactcagaacttctctgtgtctgttcccactctcatctatactggaatgggaagtggtagtgctggaaaagaaggggggccctttaaagctcttttaagacaacagactcaatcagcgttggaacagaggggaggatcgcctcataggttctgtagaaggcgggaatttccattttttaccttgacggcatttcctcctggattccttgtacacgttgggggtgtagttagtgcacgttctgtgaagcttttggatcgtatccacaatcctgatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagcaacgtcagttgattacagttcctttgcagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttgcctgttctagacaggccctgtggggtcttgaccctt

SEQ ID NO: 112697 - DNA, 3438 bp, Homo sapiens
  Payload ID: 2053
  Gene Symbol: C2CD5
  Gene Name: C2 calcium-dependent domain containing 5
  Uniprot ID: Q86YS7
  ENST ID: ENST00000542676
  CDS Start-End: 104-3259
agttaccccgcgcgcctccgcccctctcccgccggccccgcgctcggcgcagactcgtttgtttgtttctgcaggagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagattcccttcaatgaagatcccaatcccaatactcactcatcaggaccctcaacccctctgaaaaaccaaacttattccttttcaccttccaagtcctacagtcgacagtcctcttcttctgacacagatttgagtttgacacccaaaactggaatgggaagtggtagtgctggaaaagaaggggggccctttaaagctcttttaagacaacagactcaatcagcgttggaacagagggaatttccattttttaccttgacggcatttcctcctggattccttgtacacgttgggggtgtagttagtgcacgttctgtgaagcttttggatcgtatccacaatcctgatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagcaacgtcagttgattacagttcctttgcagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataaggaagaattgagtagatttgatttgcctggagtcttttggaggcatgagaattttctaatcttgacattttgtttg

SEQ ID NO: 112698 - DNA, 3471 bp, Homo sapiens
  Payload ID: 2053
  Gene Symbol: C2CD5
  Gene Name: C2 calcium-dependent domain containing 5
  Uniprot ID: Q86YS7
  ENST ID: ENST00000545552
  CDS Start-End: 203-3367
gaggagagacaagcaggggcggcagaggctcaacgggatgctgactgggttttgcttttcgtcccagccttgtggggccgggacggaagaacccatcaaagcccttcctcccgccgcctctccggaatgaggtctcagcacccgcgcgggacagcacccttcctcctgcgacagagcccaagaagaggccgaaaccgagaccatgccagggaagctgaaggtgaaaatcgtggccgggcgccatttgccagtgatggaccgtgctagtgacctgactgatgccttcgtggaggtaaaatttggtaataccacctttaaaacagatgtgtaccttaagtcactcaaccctcagtggaactcggagtggtttaaatttgaggtggatgatgaagacttacaagatgaacctttacagatcacagttcttgaccatgatacttacagtgcaaatgatgccattggtaaagtgtacattgatattgatcctttactgtatagtgaagctgcaacagtcatctcaggatggtttccaatttatgacaccatacatggtatccgtggggaaatcaatgtagttgtcaaagtagacctcttcaatgatttaaatcgatttaggcagtcatcatgtggagtcaaattcttttgcacaacgtctattccaaaatgctatagagctgtgataattcatggatttgtagaagaacttgtggtcaatgaagacccagaatatcagtggattgatcgaattcgcacaccaagggcatcaaatgaggccagacagagactcatttcgttaatgtcaggtgagctgcagaggaagattggcttgaaagtacttgaaatgagaggaaatgcagttgtggggtacttacagtgtttcgatctggagggcgagtctgggttagtggtgcgagccataggaacggcgtgtactctggataaattaagtagcccagcagcattccttcctgcatgtaattccccatccaaagaaatgaaggagtctccgctggttcatcctccaagccatggatgccgctcgactcacaacagcccaattcacactgctactggctcacgacttactcagaacttctctgtgtctgttcccactctcatctatactggaatgggaagtggtagtgctggaaaagaaggggggccctttaaagctcttttaagacaacagactcaatcagcgttggaacagagggaatttccattttttaccttgacggcatttcctcctggattccttgtacacgttgggggtgtagttagtgcacgttctgtgaagcttttggatcgtatccacaatcctgcctttgtcggaattatgggtaacacaagatcttacaaactgctagactggaatagtttcaattcagatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctataactgcaggaaacaaaaagttcctgatgttctgtttacaactatagacctcccaacagatgcaacagttattggaaaaggttgtcttattcaagcaaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctgaggaaaattaggaaaaaagagctcaactaaatgaaattcatcaatctctgttattttgtcattaattatcttcttagacttaaaattgaacttgagataaataag

SEQ ID NO: 112699 - DNA, 544 bp, Homo sapiens
  Payload ID: 2053
  Gene Symbol: C2CD5
  Gene Name: C2 calcium-dependent domain containing 5
  ENST ID: ENST00000535555
  CDS Start-End: 1-544
acaacagactcaatcagcgttggaacagaggggaggatcgcctcataggttctgtagaaggcgggaatttccattttttaccttgacggcatttcctcctggattccttgtacacgttgggggtgtagttagtgcacgttctgtgaagcttttggatcgtatccacaatcctgcctttgtcggaattatgggtaacacaagatcttacaaactgctagactggaatagtttcaattcagatgaaccagaaactcgagatgcatggtgggcagaaatcagacaagaaataaaatcacatgctaaagcattaggctgtcatgctgtagtgggctacagtgaatcaactagcatctgtgaagaggtctgcattttatctgcatctggcacagcggctgtactgaatcctagatttctgcaggatggcaccgtggaaggctgtttggaacagaggcttgaagaaaatttgcctacacgttgtggattttgtcatataccatatgatgaactgaatatgccatttccagctcatctcacatattgctat

SEQ ID NO: 112700 - DNA, 602 bp, Homo sapiens
  Payload ID: 2054
  Gene Symbol: C21orf62-AS1
  Gene Name: C21orf62 antisense RNA 1
  Uniprot ID: Q17RA5
  ENST ID: ENST00000575623
  CDS Start-End: 241-480
cacttacgcggagcggtaatgtgaggaagcctcccgccaaacagatgagggaggaggaggaggggagaggccagagagagaagcggctttcgggaaggaaagtgtgatctagtaggtggaatagtcctctccaaactttgacctgaggtgtgactattgaatgaccctctatttggatttggattacacaaagtttaacgttttttggaaaaatcctacctaggtaatgtgtagttctcaatgcatcatgtcaggcagcttatgatgccaatttgtcccatggccttaaattccacaacctcatcatctaccacctttggtgctttcagaatcatgactctcaatgttgaagaatgggctactgcatggaaggtgctgatccttttagaggcagccgtggaagaggaaaagagatcagaagagaaaaggatattggtttgcggaacatgtgggacaagaagttcccagaagaatttgtgagcaacttcccgacagtaaggccctggctagacctcaggatggtccctgcctcctggacattaggaagcccaaaggccagaacaaaaacacatgcctagtgggggaaggctcactaagagggc

SEQ ID NO: 112701 - DNA, 271 bp, Homo sapiens
  Payload ID: 2054
  Gene Symbol: C21orf62-AS1
  Gene Name: C21orf62 antisense RNA 1
  ENST ID: ENST00000572066
  CDS Start-End: 230-271
gcacttacgcggagcggtaatgtgaggaagcctcccgccaaacagatgagggaggaggaggaggggagaggccagagagagaagcggctttcgggaaggaaagtgtgatctagtaggtggaatagtcctctccaaactttgacctgagaatgaccctctatttggatttggattacacaaagtttaacgttttttggaaaaatcctacctaggtaatgtgtagttctcaatgcatcatgtcaggcagcttatgatgccaatttgtcccatg

SEQ ID NO: 112702 - DNA, 400 bp, Homo sapiens
  Payload ID: 2054
  Gene Symbol: C21orf62-AS1
  Gene Name: C21orf62 antisense RNA 1
  ENST ID: ENST00000571434
  CDS Start-End: 203-352
aagcctcccgccaaacagatgagggaggaggaggaggggagaggccagagagagaagcggctttcgggaaggaaagtgtgatctagtaggtggaatagtcctctccaaactttgacctgagaatgaccctctatttggatttggattacacaaagtttaacgttttttggaaaaatcctacctaggtaatgtgtagttctcaatgcatcatgtcaggcagcttatgatgccaatttgtcccatggtgctgatccttttagaggcagccgtggaagaggaaaagagatcagaagagaaaaggatattggtttgcggaacatgtgggacaagaagttcccagaagaatttgtgagcaacttcccgacagtaaggccctggctagacctcaggatggtccctg

SEQ ID NO: 112703 - DNA, 2453 bp, Homo sapiens
  Payload ID: 2054
  Gene Symbol: C21orf62-AS1
  Gene Name: C21orf62 antisense RNA 1
  Uniprot ID: Q17RA5
  ENST ID: ENST00000575401
  CDS Start-End: 291-530
gagatgagaagaaagagtaggctctgttgtccctcagacggcgctgctgcagtgcgtcttcgcacttacgcggagcggtaatgtgaggaagcctcccgccaaacagatgagggaggaggaggaggggagaggccagagagagaagcggctttcgggaaggaaagtgtgatctagtaggtggaatagtcctctccaaactttgacctgagaatgaccctctatttggatttggattacacaaagtttaacgttttttggaaaaatcctacctaggtaatgtgtagttctcaatgcatcatgtcaggcagcttatgatgccaatttgtcccatggccttaaattccacaacctcatcatctaccacctttggtgctttcagaatcatgactctcaatgttgaagaatgggctactgcatggaaggtgctgatccttttagaggcagccgtggaagaggaaaagagatcagaagagaaaaggatattggtttgcggaacatgtgggacaagaagttcccagaagaatttgtgagcaacttcccgacagtaaggccctggctagacctcaggatggtccctgcctcctggacattaggaagcccaaaggccagaacaaaaacacatgcctagtgggggaaggctcactaagagggcaccaagtggggcaaatacccctggtaacccatttatggaggctgccacagaaatgctagttggaaattttcctccttcagtctatcatgaatttcttttttctcttttgagatgaagtcgcccgggctgcagttcagtggtgcaatctcagctcactgcaagctctgcctcccaggttccaacgattgtcttgtctcagcctcctgagtagctgagattataagcacgcaccatcatacccgactaatttttgtatttatagtagaaatggggttttgccatgttggccaggctggtcttgaactcctgaccttagggtgatccacccatcttggcctccaaaagtgctgggattacaggcatgagccactgcactcggctgtaccgtgattattagttcaaggttctctttcactggggtaaagaccttaagagagcagtttttgggctttatattctcaatttcccgcacagtgcctagcacatagcaaggactcaacaaatttcattgaatgaatgaaaaaacatagtttaccaaatgtcagtgtactcaaactcttttaactgctagctatagaaatccaattaagactcacttgggtaaaaaaaaataaaaaaataaacaaaataaactgctcacttatttgaaaaattaaggaaggatttcaggcatggcttgatccagctactcaaaaaaggttgtcagaaatgtctgtccgttcttcatttattctttctcatttgtgggctttgttcccagataagatcactccttctggggacaagatggtcactagtagatccaggtttactttctatcagctgagcaacctctcaagaaaaaataaataaataaataaacctctctttaaatagcaccaggctgctgggtgtggtggctcatacctgtaaccccagcactttgggaggctgaggtaggaggattgtgggaagccaggagttcaagaccagcccagccaacattgtgagacataatctctacaaataaaataaattagttggacatgatggtgtgcacctatagtcccagctactcgggaggctgaagcagaaggatcacttgagtctgagaattcggtgttgtttaagccaccctgttgtggtatctgctatggctgcacaggcagaaatagggacacaagtgcaggttcagggcaaggtgtgtgagcacactcagtccctggcctcggagtctctctggatggcttcttgcctagggtgactgacagagggagggatgatatgcaaaggcacctgttctcctcatgacctaaccccaattcttactccacgggttcatgacagcctattctgctggagactgtgtcttaaaacttcctcccctagtttctctcaagtacccctcgtgagctgtgatttcactgggctttgaactcttaggccatttgaggctgcagtgagctatgattgtatcactgcactccagcctagatgacagaacgagaccccatctctaatgaataaataaatatggctgggcacaatggctcaggcctgtaatcccagcatttggaagaccaagacaggcagatcgcttcagctcaggagttcgagatcattctggccaacaaggcgaaaccctgtctctaccaaaaatacaaaaattagccaggcagggtggcatgtgcctttaatcccagctacagggaggctgaggcaggagaatcacttgaacctgggaggcagaggtttcagtgagctgaaattgtgccactgcactccagcctgagtgacagagtgagactttgcaaccaaaaaa

SEQ ID NO: 112704 - DNA, 4771 bp, Homo sapiens
  Payload ID: 2055
  Gene Symbol: C2CD2L
  Gene Name: C2CD2-like
  Uniprot ID: O14523
  ENST ID: ENST00000336702
  CDS Start-End: 360-2483
gagccggtgccggcccgcgagccccagcgtctctgcagaccagtcccctccagggtccggcggggcccgcgcggtgggaggagtcgggcactggccggcgactaacgggtccgactgctgaccaagctaggagagacccggaccacggagacagagaccccggcatcgcgacccccgaggacctcctctcctcgccctgtggcacccactagtcctgggcactcagccgcggagagcccccgaccccgcgcgcccagccccgggggagcccacctcctccccgcggcccgcccgggccatgctcccccggggcagcgggtgagccccagccgggaccgggatcggagcccgcgcggagcatggatccgggctgggggcagcgggacgtgggctgggcggccttgctgatcctcttcgccgcctcgctgctcacggtgttcgcctggctgctgcaatatgcccggggcttgtggctggcgcgggcccgcggggaccggggcccgggacccgccttagccggggaacccgcgggttccctgcgggagctgggcgtgtggcgctcgctgctgcggctgcgggcgactcgggctggcgccgccgaggagccaggagtccggggcctcctggcgtcactcttcgccttcaagtctttccgggagaactggcagcgggcttgggtgcgagcgctgaacgagcaggcctgcagaaacgggagctccatccaaatcgcctttgaggaggtgccccaactcccacccagagccagcatcagtcatgtgacctgcgtagaccaatctgagcataccatggtgctgcgttgccagctctctgctgaggaggtgcggttcccagtctctgtgacccagcagtcccccgctgccgtctccatggagacctaccacgtcactctgacactgccaccaacacagttggaagtcaacctggaggaaatccctggtgaggggctgctcatatcctgggccttcactgatcgcccagatctcagcctaacggtgcttcccaagcttcaggccagggagagaggtgaagaacaagtggagctctccacaattgaggaactgatcaaggatgccatagtcagcacccagccagccatgatggtcaacctcagggcttgctctgccccaggaggcctggtacccagtgagaagccacccatgatgccccaggctcagccagccatccccagacctaaccggttattcctacggcagcttcgggcatctcacttgggaaatgagctggaaggcaccgaggaactgtgctgtgtagctgaactcgacaaccccatgcagcagaagtggaccaagcccgcgagggctggatccgaggtggagtggacagaagacctggcactggatctgggcccccagagccgggagctgaccctcaaagtgctgaggagcagcagctgtggagacaccgaactcctaggccaggccacactgcctgtgggctccccctccagaccactgtctcgaagacagttgtgcccactcaccccagggccagggaaagccctgggaccagcagccaccatggcagtggagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagcccaggggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagtttataaactggacaactggttatcctttgaaaggcagtaggcagccaggctgtgacatggatggtgtgggaggatgagacaggggcccggataatgaggttgggtagatgacacacattgtggatctgctaagaagttcctgcagggaagaaggggtgtgcagagaaaggatggaagagacaggaggctctggagtatgaaattgtagcaaaaaactcaatcaactagtacaggttagtcttcattcccctttctggaacaggctgctccttctaggatgtaatggagatcaaagcttggaccctgtaactagactgcctgcctgggtttgagtcccagctcttctaattacttgtgtgaccttgggcaagttatgtaacctctaagtgcctcagttttctcatctgtaaaatgggaacttcaatcatcatggctatcatttggttgtggatgagaagtaaatgaagtgctgagtgttaactgttgcctcagaagaaactgggagggggaagtcttagaagtgtttcaacataataaaagctctctcattctgaaatgtgggcaaatttcagggattgatagatcctagcaaactgtgtccctggttcccgtgcttgagatcttatacaggacttgaaccaggtaagctgctacaggatattgggcagaatgcaggaccaggaagcaagaaaactgagtctgccacagacaaaccaagtgatcttgagcaggcaacttctcctttggggacctcagtttcctcatatctaaaataagggtgacctggataaacattcaggtcacttccagccttgacattctatgactacctatatctcagggtgtttagggcacatgcctttgggtagatagcatgtggaaattgttactattccccatgctcctgtccacactactcaccaaatatgagatatccgggaagaatggagggtatagattttttttttcaattagataatttagttttatatatttggggggacaagtgcaggtttcttacatgcatatattgcatgcatagaggtgaagtctgggctttttttagtgtgcgcatcgcccaaatagtgaacatcatacccaataggtagtttttcaaccctcaccctcctcccaccttctcacctttcatagtctccgatgtcttttattccactctatatgtccatgtatacccattatttagctcccacttataaatgagaatatgccatatttgactttgtttctgagttatttcaccgaggataatggcctccagttccacccatgttgctggaaaacacatgatttcattcttttttatggctgagtagtattccactgtgtgtgtgtgtgttgggcgatgataatgatgtccattgctgtgtgacagcttggaatttaatttattaaagtcaagttggagttta

SEQ ID NO: 112705 - DNA, 2320 bp, Homo sapiens
  Payload ID: 2055
  Gene Symbol: C2CD2L
  Gene Name: C2CD2-like
  ENST ID: ENST00000528586
  CDS Start-End: 71-1246
tgaagaacaagtggagctctccacaattgaggaactgatcaaggatgccatagtcagcacccagccagccatgatggtcaacctcagggcttgctctgccccaggaggcctggtacccagtgagaagccacccatgatgccccaggctcagccagccatccccagacctaaccggttattcctacggcagcttcgggcatctcacttgggaaatgagctggaaggcaccgaggaactgtgctgtgtagctgaactcgacaaccccatgcagcagaagtggaccaagcccgcgagggctggatccgaggtggagtggacagaagacctggcactggatctgggcccccagagccgggagctgaccctcaaagtgctgaggagcagcagctgtggagacaccgaactcctaggccaggccacactgcctgtgggctccccctccagaccactgtctcgaagacagttgtgcccactcaccccagggccagggaaagccctgggaccagcagccaccatggcagtggagcttcactatgaggagggctctccccggaacctgggtactcccacctcctccactccacgccccagcatcacacctaccaagaagattgagcttgaccggaccatcatgcccgatggcaccattgtcaccacagtcaccactgtccagtcccggccccgtatagacggcaaattagactccccctcccgctccccgtccaaggtggaggtgaccgagaagacgacaactgtgctgagtgagagcagtggccccagcaatacctcccatagcagcagccgggacagccacctttccaacggcttggaccctgtagcagagacagcgattcgccagctgacagagcccagtgggcgggtggccaagaagacacccaccaagcgcagcactctcatcatctctggtgtttccaaggtgcccattgctcaggacgagttggcgctatccctgggctatgcggcatccctggaagcctcagtgcaggatgatgcagggaccagcggaggcccctcttcacctccctcagacccaccagccatgtctccaggaccgctagatgccctctctagtcccacaagtgtccaggaagcagacgagacaacccgttcggatatttctgagaggccatctgtggatgatattgagtcggaaacggggtccactggtgccctggagacccgcagcctcaaggatcacaaagcttcccctcttcccctgcagtgagtttcctgcgcagcggcactaagctcatcttccgccggaggcctaggcagaaggaagctggcctgagccaatcacacgatgacctctccaacgcaacggccacgcccagtgtccgaaagaaggccggcagcttttctcgccgccttatcaagcgcttttccttcaaatccaaacccaaggccaatggtaaccccagcccccagctctgaggacccagctctgaaagggcacgagttctctcagcccattccccacctccccttccataccccttcctggatctccagtgcctgggccaggaaagccctctgggttccgggaagccccgtccaccctgggccatggggccggttggaaggatacttggaacgggaagcacatgagaggtgggcacccggtgccgaggacatggacgagggactggtggctgggagggagaggagggccctgtccggcatgtgtgggtattccccagaagcatttgcctcctgctgagcctggtccctgagcggagtcccagggtgctcagctcttcagctgacccttcttcccttatttattctcttttctatttatatgtgtggcttaggaccctccgtgaacagatgatagagggcatctctcccaggtgacccttcttttctgtcccaggagggtgggtaattccctttgggatggggctcccacacctccctcaggtccccactcagaccagcaccagtgtctgcctctgagaatgttggcagctcacagagagcagggccggcccgggatggggggcaggtactccccaccttcctgcctcccctcctgctcctcatccctccctccccctttattaccgttttttgtacttgatgccttctctgtgagcagtggctctgtgggaaggagggagccgggagcctggtgggaagccttccccagagagatggctttaggggctttatttaaagactgtgatgatggagccacgcaaggctgcacctctgtgtgttgggagacgatgatgatgtccattgctgtgtgatggcttggaatttaatttattaaagtcaaattggagtttataaa

SEQ ID NO: 112706 - DNA, 2123 bp, Homo sapiens
  Payload ID: 2056
  Gene Symbol: CPAMD8
  Gene Name: C3 and PZP-like, alpha-2-macroglobulin domain containing 8
  Uniprot ID: Q8IZJ3
  ENST ID: ENST00000291440
  CDS Start-End: 33-1685
gccccagcttggccgggcgcggagcggggcgcatggcgccgggcgcactgcgcgggggctgcgaacaaagggcccccggcggcggcgcgaggacggccgcgctcggaccctggccctggcccagccctggcccggccccctccccaggcgcggcgccccccaggagccgaaaaatgagcggcgccctgctctggccgttgctcccgctcctgctcctgctgctgtcggcgcgggacggcgtgcgcgccgcgcagcctcaggccccgggttacttgattgcagctccctctgtttttcgcgcgggcgtggaggaagtcatcagcgtgaccatctttaactctccaagggaagtcacggtccaggctcagctggtggcccagggtgagccggtggtgcagagccagggagccatcctggataaagggacaatcaaactcaaggtgcccacgggcctccggggccaagcgcttctgaaagtgtggggccgcggctggcaggcggaggaggggcccctctttcacaaccagacctcggtgaccgtggacggccggggcgcttctgtattcatccagacggacaagcctgtgtacagaccccagcaccgagtgctcataagcatcttcaccgtctctccaaatctgaggcctgtcaacgagaagctggaagcctacatcctggacccccgaggctctcggatgatagagtggagacacttaaagccgttctgctgcggcatcaccaacatgagcttccccttgtccgaccagcctgtgttgggagaatggttcatttttgttgaaatgcaaggccacgcgtacaacaagtcttttgaagttcagaagtatgtgttgcccaagtttgagcttctgattgacccgccccggtatatccaagacctggacgcctgtgagacaggcactgtgcgggccaggtatacctttgggaaacctgtggctggtgccttaatgatcaacatgactgttaatggtgtagggtactacagccacgaggtgggacgccctgtcctcagaacaaccaagatcctcggctcccgggacttcgacatctgcgtgagggacatgatcccagcggacgtccctgagcacttccggggcagggtcagcatctgggccatggtgaccagtgtggacgggagccagcaggtcgcgttcgatgactccacccccgtgcagaggcagctggtggacatccggtactccaaggacacgaggaagcagttcaagccgggcctggcctacgtggggaaggtggagctatcctaccccgatggcagcccagctgagggggtgacggtccagattaaggcagagctgacaccaaaggataacatctacaccagtgaagttgtgtcccagcgtggactagtggggtttgaaatcccctccatccccacgtcagcccagcacgtgtggctggaggttttccaggaactggaagattatgatgtttctgattcctttggcgtgtccagggaggatggtcctttttggtgggctgggctgacggcacaacgacgccggcgctcctctgtcttcccgtggccttggggcatcaccaaggactctgggtttgccttcaccgtaaggagaggaaacgggactggtggtgatgaccgaccgagtgagcctgaaccaccggcaggacggtggcctctacaccgatgaggctgtccccgctttccagccccacacagggagcctggtggcagtggctccttccaggcacccccccagaacagagaagagaaaaaggactttcttccccgaaacatggatttggcattgtctcaacatcaggtacattaagatttcttttctgcgctgactttgccggttgagtgaaagacactcatgcgggtccagagagcctccggtgagatgggcaggcctgataccaacatctgagcaagacactgtgcatctttttctaacacacaaaacttcaagccatgaagccagccttgagtcccgctgcacatttggacgtttgcctgtgaaatatgaaatgcaagggctttgtgcctcttataactccctcttggggttactctatctgctctgtttgtataacgagctcattaaaatgattacagttccctggaa

SEQ ID NO: 112707 - DNA, 5355 bp, Homo sapiens
  Payload ID: 2056
  Gene Symbol: CPAMD8
  Gene Name: C3 and PZP-like, alpha-2-macroglobulin domain containing 8
  ENST ID: ENST00000388925
  CDS Start-End: 174-1685
gccccagcttggccgggcgcggagcggggcgcatggcgccgggcgcactgcgcgggggctgcgaacaaagggcccccggcggcggcgcgaggacggccgcgctcggaccctggccctggcccagccctggcccggccccctccccaggcgcggcgccccccaggagccgaaaaatgagcggcgccctgctctggccgttgctcccgctcctgctcctgctgctgtcggcgcgggacggcgtgcgcgccgcgcagcctcaggccccgggttacttgattgcagctccctctgtttttcgcgcgggcgtggaggaagtcatcagcgtgaccatctttaactctccaagggaagtcacggtccaggctcagctggtggcccagggtgagccggtggtgcagagccagggagccatcctggataaagggacaatcaaactcaaggtgcccacgggcctccggggccaagcgcttctgaaagtgtggggccgcggctggcaggcggaggaggggcccctctttcacaaccagacctcggtgaccgtggacggccggggcgcttctgtattcatccagacggacaagcctgtgtacagaccccagcaccgagtgctcataagcatcttcaccgtctctccaaatctgaggcctgtcaacgagaagctggaagcctacatcctggacccccgaggctctcggatgatagagtggagacacttaaagccgttctgctgcggcatcaccaacatgagcttccccttgtccgaccagcctgtgttgggagaatggttcatttttgttgaaatgcaaggccacgcgtacaacaagtcttttgaagttcagaagtatgtgttgcccaagtttgagcttctgattgacccgccccggtatatccaagacctggacgcctgtgagacaggcactgtgcgggccaggtatacctttgggaaacctgtggctggtgccttaatgatcaacatgactgttaatggtgtagggtactacagccacgaggtgggacgccctgtcctcagaacaaccaagatcctcggctcccgggacttcgacatctgcgtgagggacatgatcccagcggacgtccctgagcacttccggggcagggtcagcatctgggccatggtgaccagtgtggacgggagccagcaggtcgcgttcgatgactccacccccgtgcagaggcagctggtggacatccggtactccaaggacacgaggaagcagttcaagccgggcctggcctacgtggggaaggtggagctatcctaccccgatggcagcccagctgagggggtgacggtccagattaaggcagagctgacaccaaaggataacatctacaccagtgaagttgtgtcccagcgtggactagtggggtttgaaatcccctccatccccacgtcagcccagcacgtgtggctggaggttttccaggaactggaagattatgatgtttctgattcctttggcgtgtccagggaggatggtcctttttggtgggctgggctgacggcacaacgacgccggcgctcctctgtcttcccgtggccttggggcatcaccaaggactctgggtttgccttcaccgtaaggagaggaaacgggactggtggtgatgaccgaccgagtgagcctgaaccaccggcaggacggtggcctctacaccgatgaggctgtccccgctttccagccccacacagggagcctggtggcagtggctccttccaggcacccccccagaacagagaagagaaaaaggactttcttccccgaaacatggatttggcattgtctcaacatcagtgacccatctggtgaggggacactcagtgtgaaggtcccggactccatcaccagctgggtgggtgaggccgtggccctgtccacctctcagggcttaggcatcgccgagccctccctgctgaagaccttcaagcccttcttcgtggacttcatgctccccgctctcatcatccgtggggagcaggtcaagatcccgctcagtgtctacaactacatgggcacctgcgctgaggtgtacatgaagctctcggttcccaagggcatccagtttgttgggcatcctggcaaacgccatgtgaccaagaagatgtgtgtggcccccggggaggctgagcccatctgggtcgttctgtccttcagcgacctgggactcaacaacatcacggccaaagcccttgcttacggagacacaaattgctgccgggatgggaggtccagcaaacaccctgaggagaatcacgccgacaggagggtccccatcggggtggatcacgtcaggcgcagtgtgatggttgaggcggaaggagtcccccgggcgtacacctacagcgcattcttctgtcccagtgagagagtccacatctccacccccaacaagtatgagttccagtatgtgcagcggccactgcgcctcacccgctttgatgtggctgtgcgagctcacaatgatgcccgtgtggccttgtcttctgggccccaggacacagcaggcatgatcgagatcgtcctgggggggcatcagaacaccaggtcatggatctccaccagcaagatgggagagcccgtggccagtgcacacacggccaagatcctctcctgggatgaattcagaacattctggatcagctggcgtggtggccttatccaggttggccatggtccagagccatccaatgagtctgtcattgtggcctggaccctcccgaggccaccagaggtccagttcattggcttttccaccggctggggctccatgggtgaattccgaatctggaggaagatggaggtggacgagagctacagcgaggccttcaccctgggggtcccacacggcgccatccctgggtctgagcgagccaccgcctccatcatcggggacgtcatggggccaaccctgaaccacctcaacaacctcctgcggctgccgtttggctgtggagagcagaacatgatccactttgcacccaacgtctttgtcttgaagtatcttcagaaaacccagcagctcagccctgaggtggagagagagaccaccgactacctagtacaaggctaccagcgccagctgacctacaagcgccaggatggctcctacagcgcgtttggggagcgggacgcatcggggagcatgtggctcacagcctttgtcctgaagtccttcgcacaggctcgcagctttatcttcgtggacccccgggagctggctgccgccaagagctggatcatccagcagcagcaggccgatggctccttcctggccgtgggcagggtcctgaacaaggacatccagggtgggatccacggcactgtcccgctgacagcctacgtggtggttgctctcctggaaacaggcacagcctcagaggaggagagaggctccactgacaaagcgaggcacttcctggagtctgctgcgcccctggccatggacccttatagctgtgccctgactacctacgcgctgaccctgctccgcagcccggcagcccctgaggcactgcgcaagctccgtagcctggccatcatgcgagatggggtcacccactggagcctgtcaaattcctgggacgtggacaagggcacattcttgagcttcagtgacagggtctctcagtcagtggtctcggccgaggtggaaatgacagcctacgcccttctgacctacactctgctgggtgacgtggctgccgccctgcctgtggtgaagtggctgtcccagcagcgaaatgcacttgggggcttctcctccactcaggacacctgcgtggctctgcaggccttggctgaatatgccatcttgtcctatgctggaggcatcaacctcactgtctccctggcctccaccaacctggactaccaggaaaccttcgagctgcacaggaccaaccagaaggttctgcagacagcagcgatccccagcctccccacggggctgtttgtgagtgccaagggggacggctgctgcctgatgcagattgatgtcacctacaatgtgcctgacccggtggccaagccagctttccagctgctcgtaagcctccaggagcctgaggcccagggacgcccgccccccatgcctgcctccgcagctgagggttcccgaggagactggcccccagctgacgatgatgacccagcggccgatcagcatcaccaggaatacaaggtgatgctggaggtgtgcaccaggtggctgcatgcagggtcttccaatatggctgtcctggaggtgcccctgctgtcaggcttccgggcagacatcgagagcctggagcagctgctccttgacaagcacatggggatgaagaggtatgaagtggctggacgccgagtgctcttctactttgatgagatccccagccggtgcctgacgtgcgtgcggttccgtgctctccgggagtgcgtggtgggcaggacgtcggcgctgccagtctccgtgtacgactactacgaacccgccttcgaggccactcgcttctacaacgtcagcacccacagcccactcgcccgggaactgtgcgccggacccgcgtgcaacgaagtggagcgcgcccctgcccggggcccgggctggttccccggcgagtcgggccctgccgtggcccctgaggagggggcggcgatcgcgcgatgcggctgcgaccacgactgcggcgcccaggggaacccggtgtgcggctccgacggggtggtctacgccagcgcctgccgcctgcgggaggccgcctgccgccaggccgcgcccctggagcccgcgcctcccagctgctgcgccctcgagcagcggctgccggcctcgtcgtcctccacctacggggatgacctggcttctgtggccccggggcctttacagcaggacgtgaagctgaatggagccggccttgaggtggaggactcagaccctgagcctgaaggggaggcggaggacagggtcacagccgggcctcggcctcctgtgagcagcgggaacctggaaagcagcacccagagcgccagcccgttccacagatggggccagactccggcccctcagagacatagtggccgggtggtgggggcccacaggccagggcttctgagccctgtcttcgtctacagcccagcctttcagagtggtggggaggagggtttatggatgtcaaacacctgcaccttgagataatcctacaaccacatgcagttgtgggaccgcagtttggtcctggggaccattcatacccacacacccagcttgtgcctgtggttaacatctcagaaaactctggtaaatgatcactccaggatattgacaagaatacacgttactgatcttactcac

SEQ ID NO: 112708 - DNA, 5992 bp, Homo sapiens
  Payload ID: 2056
  Gene Symbol: CPAMD8
  Gene Name: C3 and PZP-like, alpha-2-macroglobulin domain containing 8
  Uniprot ID: Q8IZJ3
  ENST ID: ENST00000443236
  CDS Start-End: 33-5831
gccccagcttggccgggcgcggagcggggcgcatggcgccgggcgcactgcgcgggggctgcgaacaaagggcccccggcggcggcgcgaggacggccgcgctcggaccctggccctggcccagccctggcccggccccctccccaggcgcggcgccccccaggagccgaaaaatgagcggcgccctgctctggccgttgctcccgctcctgctcctgctgctgtcggcgcgggacggcgtgcgcgccgcgcagcctcaggccccgggttacttgattgcagctccctctgtttttcgcgcgggcgtggaggaagtcatcagcgtgaccatctttaactctccaagggaagtcacggtccaggctcagctggtggcccagggtgagccggtggtgcagagccagggagccatcctggataaagggacaatcaaactcaaggtgcccacgggcctccggggccaagcgcttctgaaagtgtggggccgcggctggcaggcggaggaggggcccctctttcacaaccagacctcggtgaccgtggacggccggggcgcttctgtattcatccagacggacaagcctgtgtacagaccccagcaccgagtgctcataagcatcttcaccgtctctccaaatctgaggcctgtcaacgagaagctggaagcctacatcctggacccccgaggctctcggatgatagagtggagacacttaaagccgttctgctgcggcatcaccaacatgagcttccccttgtccgaccagcctgtgttgggagaatggttcatttttgttgaaatgcaaggccacgcgtacaacaagtcttttgaagttcagaagtatgtgttgcccaagtttgagcttctgattgacccgccccggtatatccaagacctggacgcctgtgagacaggcactgtgcgggccaggtatacctttgggaaacctgtggctggtgccttaatgatcaacatgactgttaatggtgtagggtactacagccacgaggtgggacgccctgtcctcagaacaaccaagatcctcggctcccgggacttcgacatctgcgtgagggacatgatcccagcggacgtccctgagcacttccggggcagggtcagcatctgggccatggtgaccagtgtggacgggagccagcaggtcgcgttcgatgactccacccccgtgcagaggcagctggtggacatccggtactccaaggacacgaggaagcagttcaagccgggcctggcctacgtggggaaggtggagctatcctaccccgatggcagcccagctgagggggtgacggtccagattaaggcagagctgacaccaaaggataacatctacaccagtgaagttgtgtcccagcgtggactagtggggtttgaaatcccctccatccccacgtcagcccagcacgtgtggctggagaccaaggtgatggcactgaacgggaagcctgtgggggctcagtacctgcccagctacctctccctcggcagctggtactcccccagccagtgctacctgcagctgcagccaccctcccacccactgcaggttggggaagaagcctatttttctgtgaagtccacatgtccctgcaactttaccctgtactacgaggtggctgcacggggcaatattgtgctatcgggccagcagcctgcccacaccacccagcagcgaagcaagcgggcggcccctgccctggagaaaccgattcgtttaacacacctttctgagacagagcccccaccagccccagaagctgaggtcgacgtgtgtgtgacctctcttcatctggccgtgacccccagcatggtcccccttggtcgcctgctggtcttctacgtcagggagaatggagaaggggtcgccgacagccttcagtttgcagtcgagaccttcttcgaaaaccaggtttcagtgacgtattcagcaaatgagacccaacctggggaggttgtcgacctgcggatcagggctgcaaggggcagctgtgtgtgcgtcgccgcagttgataagagtgtctacctgctcaggtctgggttccggctgactcctgcccaggttttccaggaactggaagattatgatgtttctgattcctttggcgtgtccagggaggatggtcctttttggtgggctgggctgacggcacaacgacgccggcgctcctctgtcttcccgtggccttggggcatcaccaaggactctgggtttgccttcaccgaaacgggactggtggtgatgaccgaccgagtgagcctgaaccaccggcaggacggtggcctctacaccgatgaggctgtccccgctttccagccccacacagggagcctggtggcagtggctccttccaggcacccccccagaacagagaagagaaaaaggactttcttccccgaaacatggatttggcattgtctcaacatcagtgacccatctggtgaggggacactcagtgtgaaggtcccggactccatcaccagctgggtgggtgaggccgtggccctgtccacctctcagggcttaggcatcgccgagccctccctgctgaagaccttcaagcccttcttcgtggacttcatgctccccgctctcatcatccgtggggagcaggtcaagatcccgctcagtgtctacaactacatgggcacctgcgctgaggtgtacatgaagctctcggttcccaagggcatccagtttgttgggcatcctggcaaacgccatgtgaccaagaagatgtgtgtggcccccggggaggctgagcccatctgggtcgttctgtccttcagcgacctgggactcaacaacatcacggccaaagcccttgcttacggagacacaaattgctgccgggatgggaggtccagcaaacaccctgaggagaatcacgccgacaggagggtccccatcggggtggatcacgtcaggcgcagtgtgatggttgaggcggaaggagtcccccgggcgtacacctacagcgcattcttctgtcccagtgagagagtccacatctccacccccaacaagtatgagttccagtatgtgcagcggccactgcgcctcacccgctttgatgtggctgtgcgagctcacaatgatgcccgtgtggccttgtcttctgggccccaggacacagcaggcatgatcgagatcgtcctgggggggcatcagaacaccaggtcatggatctccaccagcaagatgggagagcccgtggccagtgcacacacggccaagatcctctcctgggatgaattcagaacattctggatcagctggcgtggtggccttatccaggttggccatggtccagagccatccaatgagtctgtcattgtggcctggaccctcccgaggccaccagaggtccagttcattggcttttccaccggctggggctccatgggtgaattccgaatctggaggaagatggaggtggacgagagctacagcgaggccttcaccctgggggtcccacacggcgccatccctgggtctgagcgagccaccgcctccatcatcggggacgtcatggggccaaccctgaaccacctcaacaacctcctgcggctgccgtttggctgtggagagcagaacatgatccactttgcacccaacgtctttgtcttgaagtatcttcagaaaacccagcagctcagccctgaggtggagagagagaccaccgactacctagtacaaggctaccagcgccagctgacctacaagcgccaggatggctcctacagcgcgtttggggagcgggacgcatcggggagcatgtggctcacagcctttgtcctgaagtccttcgcacaggctcgcagctttatcttcgtggacccccgggagctggctgccgccaagagctggatcatccagcagcagcaggccgatggctccttcctggccgtgggcagggtcctgaacaaggacatccagggtgggatccacggcactgtcccgctgacagcctacgtggtggttgctctcctggaaacaggcacagcctcagaggaggagagaggctccactgacaaagcgaggcacttcctggagtctgctgcgcccctggccatggacccttatagctgtgccctgactacctacgcgctgaccctgctccgcagcccggcagcccctgaggcactgcgcaagctccgtagcctggccatcatgcgagatggggtcacccactggagcctgtcaaattcctgggacgtggacaagggcacattcttgagcttcagtgacagggtctctcagtcagtggtctcggccgaggtggaaatgacagcctacgcccttctgacctacactctgctgggtgacgtggctgccgccctgcctgtggtgaagtggctgtcccagcagcgaaatgcacttgggggcttctcctccactcaggacacctgcgtggctctgcaggccttggctgaatatgccatcttgtcctatgctggaggcatcaacctcactgtctccctggcctccaccaacctggactaccaggaaaccttcgagctgcacaggaccaaccagaaggttctgcagacagcagcgatccccagcctccccacggggctgtttgtgagtgccaagggggacggctgctgcctgatgcagattgatgtcacctacaatgtgcctgacccggtggccaagccagctttccagctgctcgtaagcctccaggagcctgaggcccagggacgcccgccccccatgcctgcctccgcagctgagggttcccgaggagactggcccccagctgacgatgatgacccagcggccgatcagcatcaccaggaatacaaggtgatgctggaggtgtgcaccaggtggctgcatgcagggtcttccaatatggctgtcctggaggtgcccctgctgtcaggcttccgggcagacatcgagagcctggagcagctgctccttgacaagcacatggggatgaagaggtatgaagtggctggacgccgagtgctcttctactttgatgagatccccagccggtgcctgacgtgcgtgcggttccgtgctctccgggagtgcgtggtgggcaggacgtcggcgctgccagtctccgtgtacgactactacgaacccgccttcgaggccactcgcttctacaacgtcagcacccacagcccactcgcccgggaactgtgcgccggacccgcgtgcaacgaagtggagcgcgcccctgcccggggcccgggctggttccccggcgagtcgggccctgccgtggcccctgaggagggggcggcgatcgcgcgatgcggctgcgaccacgactgcggcgcccaggggaacccggtgtgcggctccgacggggtggtctacgccagcgcctgccgcctgcgggaggccgcctgccgccaggccgcgcccctggagcccgcgcctcccagctgctgcgccctcgagcagcggctgccggcctcgtcgtcctccacctacggggatgacctggcttctgtggccccggggcctttacagcaggacgtgaagctgaatggagccggccttgaggtggaggactcagaccctgagcctgaaggggaggcggaggacagggtcacagccgggcctcggcctcctgtgagcagcgggaacctggaaagcagcacccagagcgccagcccgttccacagatggggccagactccggcccctcagagacatagtggccgggtggtgggggcccacaggccagggcttctgagccctgtcttcgtctacagcccagcctttcagagtggtggggaggagggtttatggatgtcaaacacctgcaccttgagataatcctacaaccacatgcagttgtgggaccgcagtttggtcctggggaccattcatacccacacacccagcttgtgcctgtggttaacatctcagaaaactctggtaaatgatcactccaggatattgacaagaatacacgttactgatcttactcacatgtt

SEQ ID NO: 112709 - DNA, 526 bp, Homo sapiens
  Payload ID: 2056
  Gene Symbol: CPAMD8
  Gene Name: C3 and PZP-like, alpha-2-macroglobulin domain containing 8
  ENST ID: ENST00000599287
  CDS Start-End: 1-526
ctgctccttgacaagcacatggggatgaagaggtatgaagtggctggacgccgagtgctcttctactttgatgagatccccagccggtgcctgacgtgcgtgcggttccgtgctctccgggagtgcgtggtgggcaggacgtcggcgctgccagtctccgtgtacgactactacgaacccgccttcgaggccactcgcttctacaacgtcagcacccacagcccactcgcccgggaactgtgcgccggacccgcgtgcaacgaagtggagcgcgcccctgcccggggcccgggctggttccccggcgagtcgggccctgccgtggcccctgaggagggggcggcgatcgcgcgatgcggctgcgaccacgactgcggcgcccaggggaacccggtgtgcggctccgacggggtggtctacgccagcgcctgccgcctgcgggaggccgcctgccgccaggccgcgcccctggagcccgcgcctcccagctgctgcgccctcgcaggacgtgaagctgaatggagcc

SEQ ID NO: 112710 - DNA, 2481 bp, Homo sapiens
  Payload ID: 2056
  Gene Symbol: CPAMD8
  Gene Name: C3 and PZP-like, alpha-2-macroglobulin domain containing 8
  ENST ID: ENST00000594249
  CDS Start-End: 1-1016
ttgtgagtgccaagggggacggctgctgcctgatgcagattgatgtcacctacaatgtgcctgacccggtggccaagccagctttccagctgctcgtaagcctccaggagcctgaggcccagggacgcccgccccccatgcctgcctccgcagctgagggttcccgaggagactggcccccagctgacgatgatgacccagcggccgatcagcatcaccaggaatacaaggtgatgctggaggtgtgcaccaggtggctgcatgcagggtcttccaatatggctgtcctggaggtgcccctgctgtcaggcttccgggcagacatcgagagcctggagcagctgctccttgacaagcacatggggatgaagaggtatgaagtggctggacgccgagtgctcttctactttgatgagatccccagccggtgcctgacgtgcgtgcggttccgtgctctccgggagtgcgtggtgggcaggacgtcggcgctgccagtctccgtgtacgactactacgaacccgccttcgaggccactcgcttctacaacgtcagcacccacagcccactcgcccgggaactgtgcgccggacccgcgtgcaacgaagtggagcgcgcccctgcccggggcccgggctggttccccggcgagtcgggccctgccgtggcccctgaggagggggcggcgatcgcgcgatgcggctgcgaccacgactgcggcgcccaggggaacccggtgtgcggctccgacggggtggtctacgccagcgcctgccgcctgcgggaggccgcctgccgccaggccgcgcccctggagcccgcgcctcccagctgctgcgccctcgagcagcggctgccggcctcgtcgtcctccacctacggggatgacctggcttctgtggccccggggcctttacagcaggacgtgaagctgaatggagccggccttgaggtggaggactcagaccctgagcctgaaggggaggcggaggacagtcagagcggcttctcttcctaacggctgccctgctgagagcaggacgacaccatctggctgcatcctgtccctatcagcctgtgactctgtatggtgggtgggcagacctcagcccaggtgacacctgcctctaaatgaacccaaggaacagaatgacagagatctgcccgtccctaggatgagactcttgggacccaggtgtgggctcagcagtcaccggtgtggtgcaggggggacagctggaggtcccttgggagatcccccaccttcctagctacagctggagctccaagcaccccaaccccccagccttggagctgggcatcattttcctggggccacggcagctcccacagcctgacattctgttcccgggagaagaaacattcccagaaagcactcgtgtggccaaaagcctctttctgagcaaacacgatgtggactaaattagcaaaacatccagccggtgggcaacttcaaaacggaacaggctgcgtttctctgaaacacaaagccccggcctccctttggggcacccaggaccccaaattgccctaagactgtcccagctctcgcaccctctgccttcgccccccggggacctcgggctcacatcacaaggccctgcggggaagcagatggctctcagcaaatgcactttcagcttccggctgccggggctgggtgaccccggtgcttcctcaccgtgagttcctgatgtcctcgtgcccagaggaccagcccactcccagggcccccaggcccagaacctgcctgccttggggggccctaccagctgcctgccaccagtaccagcagactttgattcccctttgtgacccctggcacctgcttatgtctgcatttgcccatcttctccggggtggtatttatttcagccaacaccgctcagccctgatctctgccagcacggaggcccctcgctgcctgtgagatcaaggtctgaggctgccctggccggtgggttccccacccctggcaccctacaagcgacaggccctgtggctccttcctcagcccgaggccccgtgcccacttgctgtagaggatgttgtaagataaaacctcatctccagggtcacagccgggcctcggcctcctgtgagcagcgggaacctggaaagcagcacccagagcgccagcccgttccacagatggggccagactccggcccctcagagacatagtggccgggtggtgggggcccacaggccagggcttctgagccctgtcttcgtctacagcccagcctttcagagtggtggggaggagggtttatggatgtcaaacacctgcaccttgagataatcctacaaccacatgcagttgtgggaccgcagtttggtcctggggaccattcatacccacacacccagcttgtgcctgtggttaacatctcagaaaactctggtaaatgatcactccaggatattgacaagaatacacgttactgatcttactcaca

SEQ ID NO: 112711 - DNA, 466 bp, Homo sapiens
  Payload ID: 2056
  Gene Symbol: CPAMD8
  Gene Name: C3 and PZP-like, alpha-2-macroglobulin domain containing 8
  ENST ID: ENST00000598792
  CDS Start-End: 1-171
aggactcagaccctgagcctgaaggggaggcggaggacagagcggcttctcttcctaacggctgccctgctgagagcaggacgacaccatctggctgcatcctgtccctatcagcctgtgactctgtatggtgggtgggcagacctcagcccaggtgacacctgcctctaaatgaacccaaggaacagaatgacagagatctgcccgtccctaggatgagactcttgggacccaggtgtgggctcagcagtcaccggtgtggtgcaggggggacagctggaggtcccttgggagatcccccaccttcctagctacagctggagctccaagcaccccaaccccccagccttggagctgggcatcattttcctggggccacggcagctcccacagcctgacattctgttcccgggagaagaaacattcccagaaagcactcgtgtggccaaaagcctctttctgagca

SEQ ID NO: 112712 - DNA, 1661 bp, Homo sapiens
  Payload ID: 2057
  Gene Symbol: C7orf55-LUC7L2
  Gene Name: C7orf55-LUC7L2 readthrough
  ENST ID: ENST00000541515
  CDS Start-End: 26-1402
accacgctcggagaaggacaggacaatggcggccttagggtccccgtcgcacacttttcgaggacttctgcgggagttgcgctacctgagcgcggccaccggccgaccctatcgcgacaccgcggcctatcggtaccttgtgaaggctttccgtgcacatcgggtcaccagtgaaaagttgtgcagagcccaacatgagcttcatttccaagctgccacctatctctgcctcctgcgtagcatccggaaacatgtggccctacatcaggaatttcatggcaagggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattcttt

SEQ ID NO: 112713 - DNA, 2949 bp, Homo sapiens
  Payload ID: 2058
  Gene Symbol: C8orf44-SGK3
  Gene Name: C8orf44-SGK3 readthrough
  ENST ID: ENST00000519289
  CDS Start-End: 568-2058
agttatggcagtgggagtcgaagcgagggtctgaagttcacgactactagaaggggaggggagtggaaaggctctcagtgaaaaaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgaatgtctcctgtcttcctccagcattcacaaaccaggaacggctagctttttgacctgttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaa

SEQ ID NO: 112714 - DNA, 4591 bp, Homo sapiens
  Payload ID: 2059
  Gene Symbol: CADPS
  Gene Name: Ca++-dependent secretion activator
  Uniprot ID: Q9ULU8
  ENST ID: ENST00000283269
  CDS Start-End: 213-4157
ctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagggaaaaagagagaaatgtatgagcatcctgtcttctgcttggcctcccaagtgatggatttaaccattcaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaaca

SEQ ID NO: 112715 - DNA, 5190 bp, Homo sapiens
  Payload ID: 2059
  Gene Symbol: CADPS
  Gene Name: Ca++-dependent secretion activator
  Uniprot ID: Q9ULU8
  ENST ID: ENST00000357948
  CDS Start-End: 310-4134
tcagcagccgcagatggcatccggctgcgggctcggggctcgcaattgattctcccccttgcccacctcgagtccacggacgcacctctcccttcccctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaa

SEQ ID NO: 112716 - DNA, 5471 bp, Homo sapiens
  Payload ID: 2059
  Gene Symbol: CADPS
  Gene Name: Ca++-dependent secretion activator
  Uniprot ID: Q9ULU8
  ENST ID: ENST00000383710
  CDS Start-End: 351-4412
acagcttgcaacactcggcatcttttctggaggcgcctccttcagcagccgcagatggcatccggctgcgggctcggggctcgcaattgattctcccccttgcccacctcgagtccacggacgcacctctcccttcccctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagagaatcaaaaggatgcagaaaatgtaggccggttaatcactcctgccaaaaagcttgaagatacaatacgtcttgctgaactagtcattgaagttcttcagcaaaatgaggagcaccacgcagagccacatgttgataaaggagaagcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaagagtttaaccagtaacctacccaatgtgaacctacccaatgtgaaccttcccaaagtaccaaatctaccagttaacatccctctaggcatcccacaaatgcctactttttcggcaccgtcatggatggctgctatatatgatgcggataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaatat

SEQ ID NO: 112717 - DNA, 570 bp, Homo sapiens
  Payload ID: 2059
  Gene Symbol: CADPS
  Gene Name: Ca++-dependent secretion activator
  ENST ID: ENST00000466621
  CDS Start-End: 1-570
aaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaat

SEQ ID NO: 112718 - DNA, 719 bp, Homo sapiens
  Payload ID: 2059
  Gene Symbol: CADPS
  Gene Name: Ca++-dependent secretion activator
  ENST ID: ENST00000468271
  CDS Start-End: 1-719
acgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacagtcaacaaatgcatgtgtaccttagtgggctgccaccaaatacagaccctgaagggagcaaaactccctccccacctgaaccagaagctaaaaaagataccaaaaaggaatccaaaaaaagaaaagattccaaaacccaggcaaatcaagagctgaaaaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctg

SEQ ID NO: 112719 - DNA, 933 bp, Homo sapiens
  Payload ID: 2059
  Gene Symbol: CADPS
  Gene Name: Ca++-dependent secretion activator
  ENST ID: ENST00000491424
  CDS Start-End: 1-933
taatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagagaatcaaaaggatgcagaaaatgtaggccggttaatcactcctgccaaaaagcttgaagatacaatacgtcttgctgaactagtcattgaagttcttcagcaaaatgaggagcaccacgcagaggggaaagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaa

SEQ ID NO: 112720 - DNA, 2669 bp, Homo sapiens
  Payload ID: 2059
  Gene Symbol: CADPS
  Gene Name: Ca++-dependent secretion activator
  Uniprot ID: Q9ULU8
  ENST ID: ENST00000490353
  CDS Start-End: 1-1374
atgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacggtaatcaggagaaacagaagagaacaactgcctcacagtgccatttgatgtcccgtctttgtgccatgtcaaatcatctccaggggtacaagatttgtgcttgaagagtcacagtacccaatctctgtttactgaataatttcactatagtctgtgtatttccctggtttacactcatccttttgggtgtttttcctagagcattccatggtttcttttctgtttagtaaatccgtgccagcttgcaaagtgacgtgaatgagaaagatggaattagtaatgttgttgaatgtgaacactcaagacaaaagaaagaaaacattttcccccttagctggctttgtcttctcaatgaccggaatgaaatgtcaagtgaacgtgttaattcttaatggggataccaatgaaagcttcaggggaagagaacatttaacagaggctctcacttttctctgaattttatttggatagacattagcattttattacagccttggaaaagatgagatgacaattattgacaaggttcccaggacacaaataaataaaatgaataaattgtttatttgataaatttcaattatctacaaggtgtaaaacactatagatgcgaatgattaaaaaataaagagcaaagaccctgttttcaggatgcagcatacttacagggaaataaatcatgtacatttagtagtgaatataaaaaagtaaagattccattctggggaaaactgcagattgcttctgttgagaaaaccaaagaatggtcctggagaagatggctcttgaaaatggcccttgaatttggctagaaagcatttgcaagtacagaaagggtggcaagggcattccagcaaaacgaagtggtatccgccaacacctatagtctcagaagtgctgtactgtgtagggaacgtaggttctaaaaaggaggtataaaaggaggaagagaaaagaaagaaatctataaatataggctgagtcaaggtataaaagagctttgcggacgaaactaagaggaagagagcttaaagaaacaagtacatttagcagggataggataaacactggggacagagagctcctgaaccagtgtgacccggctccagtggtgtcctgtttctgtgcctctccattcatgtgaacatgtgtgtgcatgtgtgtgcgtgtgtgtgtgtgtgtgtgtgtgtgaaaaacttttatgacaaaattgaaatgacattgttagtcatacattttgacattgaattttacaatgtttatgcatctaagcttgcagccgttatacttggataatctatgtctttgtttctgctataaaaccatgttttctcttggtgtgg

SEQ ID NO: 112721 - DNA, 2095 bp, Homo sapiens
  Payload ID: 2059
  Gene Symbol: CADPS
  Gene Name: Ca++-dependent secretion activator
  ENST ID: ENST00000473635
  CDS Start-End: 1-1037
acctacccaatgtgaacctacccaatgtgaaccttcccaaagtaccaaatctaccagttaacatccctctaggcatcccacaaatgcctactttttcggcaccgtcatggatggctgctatatatgatgcggataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagtttgctaaaatgtggcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaata

SEQ ID NO: 112722 - DNA, 637 bp, Homo sapiens
  Payload ID: 2059
  Gene Symbol: CADPS
  Gene Name: Ca++-dependent secretion activator
  ENST ID: ENST00000542833
  CDS Start-End: 1-637
caagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttctggactgaaggacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacg

SEQ ID NO: 112723 - DNA, 1804 bp, Homo sapiens
  Payload ID: 2059
  Gene Symbol: CADPS
  Gene Name: Ca++-dependent secretion activator
  ENST ID: ENST00000613879
  CDS Start-End: 85-753
aatagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagtttgctaaaatgtggcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcct

SEQ ID NO: 112724 - DNA, 5455 bp, Homo sapiens
  Payload ID: 2059
  Gene Symbol: CADPS
  Gene Name: Ca++-dependent secretion activator
  ENST ID: ENST00000612439
  CDS Start-End: 361-4395
ggctgcatcgacagcttgcaacactcggcatcttttctggaggcgcctccttcagcagccgcagatggcatccggctgcgggctcggggctcgcaattgattctcccccttgcccacctcgagtccacggacgcacctctcccttcccctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacagtcaacaaatgcatgtgtaccttagtgggctgccaccaaatacagaccctgaagggagcaaaactccctccccacctgaaccagaagctaaaaaagataccaaaaaggaatccaaaaaaagaaaagattccaaaacccaggcaaatcaagagctgaaaaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaatata

SEQ ID NO: 112725 - DNA, 6065 bp, Homo sapiens
  Payload ID: 2060
  Gene Symbol: CADPS2
  Gene Name: Ca++-dependent secretion activator 2
  ENST ID: ENST00000313070
  CDS Start-End: 741-4325
attcaattccacgtgttgcttgttgtaggcgccacaggttccccacctgcgtccgggcgctcgggcggctccgcctctgccggcgggctctggggaaccgctgggtcggcgcgcccggggctggcggagcaattcctgaggcgcccaagctcacccccaacgctaactccgcctattcagtcccggcggctccccctctcccccctcccaatcctcctcccggctcctgcccgcccctttcgccctggtggtaggaaacactcctgaatctaactcgacgtgtccggaaagccctggccagttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttctggtaaagatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaaggcccagcagaaaaggaaacagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatcccaactatctgactctgtgtttttgtttcttgagttttttgtttgttttgtttgtaatattttgtttttaatcaaatgagtaaaagatagtaacactgactgttctttgtacctaataggcacatacattgttaaaagaattactatgacagcatatttccatagcagaggaaatatatatttcatatattattagttaatattagtaatcaatgttaactaataattagtaatgttagtaatattaactagtaattcacattattagtggttctctcaaaatattttcttgctagggtttgagagataattgtattatgttgcgtaagttctctatgaattatttttgtgatatttcccaaaacatattggcagattgtgctactgcatttattaataagtaatttttaaatgaaggcagttaatgcagaataagtggaggtatccctgcatttatgaaaacgtttattctgaaactttagaaatgaaacaacttggacctccagattcgttctcccatggtgtaataagtggtcgttaggtacctagactagccttaaaaatctatttaatctacagttactatttagcattgttttggctcattttctgggccctagggctaagataacaaacaaggaaatttcttccttcttccgggattaaagactaactctaccaactcactatctttgaaaggcagtttgggaatgttctccctccttttcttctctattcacacaccaaatactattttctccaaaccctcaaatgtccagtcatgctatcccaaactctccaatggcaccatccccaagcttgctgttccacgacacattgctctgtacttagtaattacccacccttcttttcctttcaataaaatgtccatttccttgatac

SEQ ID NO: 112726 - DNA, 6045 bp, Homo sapiens
  Payload ID: 2060
  Gene Symbol: CADPS2
  Gene Name: Ca++-dependent secretion activator 2
  ENST ID: ENST00000334010
  CDS Start-End: 423-4307
attcaattccacgtgttgcttgttgtaggcgccacaggttccccacctgcgtccgggcgctcgggcggctccgcctctgccggcgggctctggggaaccgctgggtcggcgcgcccggggctggcggagcaattcctgaggcgcccaagctcacccccaacgctaactccgcctattcagtcccggcggctccccctctcccccctcccaatcctcctcccggctcctgcccgcccctttcgccctggtggtaggaaacactcctgaatctaactcgacgtgtccggaaagccctggccagttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttctgaatttacagatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatcccaactatctgactctgtgtttttgtttcttgagttttttgtttgttttgtttgtaatattttgtttttaatcaaatgagtaaaagatagtaacactgactgttctttgtacctaataggcacatacattgttaaaagaattactatgacagcatatttccatagcagaggaaatatatatttcatatattattagttaatattagtaatcaatgttaactaataattagtaatgttagtaatattaactagtaattcacattattagtggttctctcaaaatattttcttgctagggtttgagagataattgtattatgttgcgtaagttctctatgaattatttttgtgatatttcccaaaacatattggcagattgtgctactgcatttattaataagtaatttttaaatgaaggcagttaatgcagaataagtggaggtatccctgcatttatgaaaacgtttattctgaaactttagaaatgaaacaacttggacctccagattcgttctcccatggtgtaataagtggtcgttaggtacctagactagccttaaaaatctatttaatctacagttactatttagcattgttttggctcattttctgggccctagggctaagataacaaacaaggaaatttcttccttcttccgggattaaagactaactctaccaactcactatctttgaaaggcagtttgggaatgttctccctccttttcttctctattcacacaccaaatactattttctccaaaccctcaaatgtccagtcatgctatcccaaactctccaatggcaccatccccaagcttgctgttccacgacacattgctctgtacttagtaattacccacccttcttttcctttcaataaaatgtccatttccttgat

SEQ ID NO: 112727 - DNA, 2826 bp, Homo sapiens
  Payload ID: 2060
  Gene Symbol: CADPS2
  Gene Name: Ca++-dependent secretion activator 2
  ENST ID: ENST00000397721
  CDS Start-End: 1-2698
tgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaacaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaa

SEQ ID NO: 112728 - DNA, 4073 bp, Homo sapiens
  Payload ID: 2060
  Gene Symbol: CADPS2
  Gene Name: Ca++-dependent secretion activator 2
  Uniprot ID: Q86UW7
  ENST ID: ENST00000449022
  CDS Start-End: 21-3911
ggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttctggtaaagatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagagggaagagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgcc

SEQ ID NO: 112729 - DNA, 4308 bp, Homo sapiens
  Payload ID: 2060
  Gene Symbol: CADPS2
  Gene Name: Ca++-dependent secretion activator 2
  Uniprot ID: Q86UW7
  ENST ID: ENST00000412584
  CDS Start-End: 122-3889
ttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaacaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagtttggtagtcaatggcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaa

SEQ ID NO: 112730 - DNA, 2238 bp, Homo sapiens
  Payload ID: 2060
  Gene Symbol: CADPS2
  Gene Name: Ca++-dependent secretion activator 2
  ENST ID: ENST00000462699
  CDS Start-End: 1-1472
attacactagactcacagaatatgccaaaatagaaggcccagcagaaaaggaaacagagaccatgaaccaggcatctcctgctagaaagctggaagagattcttcatctggcagagctctgcatagaagtcttacagcagaatgaagagcatcatgcagagggaagagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcat

SEQ ID NO: 112731 - DNA, 6066 bp, Homo sapiens
  Payload ID: 2060
  Gene Symbol: CADPS2
  Gene Name: Ca++-dependent secretion activator 2
  ENST ID: ENST00000615869
  CDS Start-End: 423-4328
attcaattccacgtgttgcttgttgtaggcgccacaggttccccacctgcgtccgggcgctcgggcggctccgcctctgccggcgggctctggggaaccgctgggtcggcgcgcccggggctggcggagcaattcctgaggcgcccaagctcacccccaacgctaactccgcctattcagtcccggcggctccccctctcccccctcccaatcctcctcccggctcctgcccgcccctttcgccctggtggtaggaaacactcctgaatctaactcgacgtgtccggaaagccctggccagttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttctgaatttacagatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaaggcccagcagaaaaggaaacagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatcccaactatctgactctgtgtttttgtttcttgagttttttgtttgttttgtttgtaatattttgtttttaatcaaatgagtaaaagatagtaacactgactgttctttgtacctaataggcacatacattgttaaaagaattactatgacagcatatttccatagcagaggaaatatatatttcatatattattagttaatattagtaatcaatgttaactaataattagtaatgttagtaatattaactagtaattcacattattagtggttctctcaaaatattttcttgctagggtttgagagataattgtattatgttgcgtaagttctctatgaattatttttgtgatatttcccaaaacatattggcagattgtgctactgcatttattaataagtaatttttaaatgaaggcagttaatgcagaataagtggaggtatccctgcatttatgaaaacgtttattctgaaactttagaaatgaaacaacttggacctccagattcgttctcccatggtgtaataagtggtcgttaggtacctagactagccttaaaaatctatttaatctacagttactatttagcattgttttggctcattttctgggccctagggctaagataacaaacaaggaaatttcttccttcttccgggattaaagactaactctaccaactcactatctttgaaaggcagtttgggaatgttctccctccttttcttctctattcacacaccaaatactattttctccaaaccctcaaatgtccagtcatgctatcccaaactctccaatggcaccatccccaagcttgctgttccacgacacattgctctgtacttagtaattacccacccttcttttcctttcaataaaatgtccatttccttgat

SEQ ID NO: 112732 - DNA, 5275 bp, Homo sapiens
  Payload ID: 2061
  Gene Symbol: CACHD1
  Gene Name: cache domain containing 1
  ENST ID: ENST00000290039
  CDS Start-End: 107-3778
gcggccgcccctctggctgctctgcctggtcgcgtgctggctcctgggcgccggggccgaagccgacttctccatcctggacgaggcgcaagtgctggcgagccagatgcggaggctggcggccgaggagctgggggtcgtcaccatgcagcggatattcaactcctttgtttacactgagaaaatctcaaatggagaaagtgaagtacagcagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcagttcttgcagacaacctgaaatccaaccctggaattaagtggcaatatttcagttcagaagaaggaattttcactgttttcccagcacacaagttccggtgtaagggcagctacgaacaccgcagtagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggatggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggtttgataatgactgtgagtaaaccctgttattttggaaacctacttctgggaattgtaggtgtggacgtgaatctggcttacattcttgaagacgtgacgtattaccaagactctttggcttcctatacttttctcatagacgacaaaggatatacacttatgcacccatctcttaccaggccatatttattgtcagagcccccacttcatactgacatcatacattatgaaaatattccaaaatttgaattagttcggcaaaatatcctaagcctccctctgggcagccagattatcgcagtccctgtgaactcatccctgtcttggcacataaacaagctgagagaaactggaaaggaagcctacaatgttagctatgcctggaagatggtacaagacacttcctttattctgtgtattgtggtgatacaaccagaaatacctgtgaaacaactgaagaacctcaacactgttcccagcagcaagctgctgtaccaccggctggatctccttggccagcccagtgcttgcctccacttcaaacagctggcaaccctagaaagtcccaccatcatgctgtctgctggcagcttttcctccccctatgagcacctcagccagccagagacaaagcgcatggtagagcactacaccgcctatctcagcgacaacacccgcctcattgctaacccgggcctcaaattctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgacaatcagtcacacaattcattcatccagtacacagctgtcttctgggcacactgtggctgtgatgggcattgacttcacactcagatacttctacaaagttctgatggacctattacctgtctgtaaccaagatggtggcaacaaaataaggtgcttcataatggaggacaggggttatctggtggcgcacccgactctcatcgaccccaaaggacatgcacctgtggagcagcagcacatcacccacaaggagcccctggtagcaaatgatatcctcaaccaccccaactttgtaaagaaaaacctgtgcaacagcttcagtgacagaacggtccagaggttttataaattcaacaccagccttgcgggggatttgacgaaccttgtgcatggcagccactgttccaaatacagattagcaaggatcccaggaaccaacgcgtttgttggcattgtcaacgaaacctgcgactctcttgccttctgtgcctgcagcatggtggaccgactctgtctcaactgtcaccgaatggaacaaaatgaatgtgaatgtccttgtgagtgccctctagaggtcaatgagtgcactggcaacctcaccaatgcagagaaccgaaaccccagctgcgaggtccaccaggagccggtgacatacacagctattgaccctggcctgcaagatgctcttcaccagtgtgtcaacagcaggtgcagtcagaggctggaaagtggggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatggaccatt

SEQ ID NO: 112733 - DNA, 2797 bp, Homo sapiens
  Payload ID: 2062
  Gene Symbol: CACTIN
  Gene Name: cactin, spliceosome C complex subunit
  Uniprot ID: Q8WUQ7
  ENST ID: ENST00000221899
  CDS Start-End: 54-2330
cccagcgcaggcttcggctattggtgttggtgccgcggccactggcccagccgatgggtcgggacacacgctcgcgctcgcggtccgcgggtcgccggggccgaaggcggcagagtcagagcgggagccgaagtcggagcaggagccatgggcggcgaaaccgacggcgccgggaggacgagggacggcgcagacggaggcggcggagccgggagcgcaggtcagattcagaggaagagcggtggcagcgctcagggatgcgaagccggagccccccgcggcccaagtggcactcaagagatgggtcctctcagtcggactcaggagaggagcagtcacggggccagtgggctcgccggcgacggcgcgcacgctcgtggtctcctagctcctcagcatccagctccgcgtctccagggcgatcccagagcccccgggcggccgcggctgccctgagccagcagcagagcctgcaggagcggctgcggctgcgggaggagcggaagcagcaggaggagctgatgaaggccttcgagacgcccgaggagaagcgcgcacggcggctggccaagaaggaggccaaggagcgcaagaagcgggagaagatgggctggggtgaggagtacatgggctacaccaacaccgacaaccccttcggagacaacaacctgctgggcaccttcatctggaataaggccctggagaagaaggggatcagccacctggaggagaaggagctgaaggagcggaacaagaggatccaggaggacaaccggctggagctgcagaaggtgaagcagctgcggctggagcgggagcgggagaaggccatgcgcgagcaggagctggagatgctgcagcgcgagaaggaggcagagcacttcaagacatgggaggagcaggaggacaacttccacctccagcaggccaagctgcgttccaagatccgcatccgggacgggcgggccaagcccatcgacctgctggccaagtacatcagcgctgaggatgacgatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccaggtgagcgccgcgagggggtcaacgcctccgtcagctctgatgtgcagtcggtgttcaaggggaagacatacaaccagctgcaggtcatcttccagggcatcgagggcaaaatccgcgctggtggccccaacctggacatgggctactgggagagcctcctgcagcagcttcgtgcccacatggcacgggcccggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggcagcactgaggccgggaccctgctggcgcccgatccgccactgcagaagagaccctctgtggacacccacactctgcagggactggcccccaactcaccccgtgctggctggtggggtccatttccccgcagcgggccaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgt

SEQ ID NO: 112734 - DNA, 2671 bp, Homo sapiens
  Payload ID: 2062
  Gene Symbol: CACTIN
  Gene Name: cactin, spliceosome C complex subunit
  Uniprot ID: Q8WUQ7
  ENST ID: ENST00000248420
  CDS Start-End: 54-2330
cccagcgcaggcttcggctattggtgttggtgccgcggccactggcccagccgatgggtcgggacacacgctcgcgctcgcggtccgcgggtcgccggggccgaaggcggcagagtcagagcgggagccgaagtcggagcaggagccatgggcggcgaaaccgacggcgccgggaggacgagggacggcgcagacggaggcggcggagccgggagcgcaggtcagattcagaggaagagcggtggcagcgctcagggatgcgaagccggagccccccgcggcccaagtggcactcaagagatgggtcctctcagtcggactcaggagaggagcagtcacggggccagtgggctcgccggcgacggcgcgcacgctcgtggtctcctagctcctcagcatccagctccgcgtctccagggcgatcccagagcccccgggcggccgcggctgccctgagccagcagcagagcctgcaggagcggctgcggctgcgggaggagcggaagcagcaggaggagctgatgaaggccttcgagacgcccgaggagaagcgcgcacggcggctggccaagaaggaggccaaggagcgcaagaagcgggagaagatgggctggggtgaggagtacatgggctacaccaacaccgacaaccccttcggagacaacaacctgctgggcaccttcatctggaataaggccctggagaagaaggggatcagccacctggaggagaaggagctgaaggagcggaacaagaggatccaggaggacaaccggctggagctgcagaaggtgaagcagctgcggctggagcgggagcgggagaaggccatgcgcgagcaggagctggagatgctgcagcgcgagaaggaggcagagcacttcaagacatgggaggagcaggaggacaacttccacctccagcaggccaagctgcgttccaagatccgcatccgggacgggcgggccaagcccatcgacctgctggccaagtacatcagcgctgaggatgacgatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccaggtgagcgccgcgagggggtcaacgcctccgtcagctctgatgtgcagtcggtgttcaaggggaagacatacaaccagctgcaggtcatcttccagggcatcgagggcaaaatccgcgctggtggccccaacctggacatgggctactgggagagcctcctgcagcagcttcgtgcccacatggcacgggcccggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggccaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgttgtattttag

SEQ ID NO: 112735 - DNA, 3612 bp, Homo sapiens
  Payload ID: 2062
  Gene Symbol: CACTIN
  Gene Name: cactin, spliceosome C complex subunit
  Uniprot ID: Q8WUQ7
  ENST ID: ENST00000429344
  CDS Start-End: 54-2330
cccagcgcaggcttcggctattggtgttggtgccgcggccactggcccagccgatgggtcgggacacacgctcgcgctcgcggtccgcgggtcgccggggccgaaggcggcagagtcagagcgggagccgaagtcggagcaggagccatgggcggcgaaaccgacggcgccgggaggacgagggacggcgcagacggaggcggcggagccgggagcgcaggtcagattcagaggaagagcggtggcagcgctcagggatgcgaagccggagccccccgcggcccaagtggcactcaagagatgggtcctctcagtcggactcaggagaggagcagtcacggggccagtgggctcgccggcgacggcgcgcacgctcgtggtctcctagctcctcagcatccagctccgcgtctccagggcgatcccagagcccccgggcggccgcggctgccctgagccagcagcagagcctgcaggagcggctgcggctgcgggaggagcggaagcagcaggaggagctgatgaaggccttcgagacgcccgaggagaagcgcgcacggcggctggccaagaaggaggccaaggagcgcaagaagcgggagaagatgggctggggtgaggagtacatgggctacaccaacaccgacaaccccttcggagacaacaacctgctgggcaccttcatctggaataaggccctggagaagaaggggatcagccacctggaggagaaggagctgaaggagcggaacaagaggatccaggaggacaaccggctggagctgcagaaggtgaagcagctgcggctggagcgggagcgggagaaggccatgcgcgagcaggagctggagatgctgcagcgcgagaaggaggcagagcacttcaagacatgggaggagcaggaggacaacttccacctccagcaggccaagctgcgttccaagatccgcatccgggacgggcgggccaagcccatcgacctgctggccaagtacatcagcgctgaggatgacgatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccaggtgagcgccgcgagggggtcaacgcctccgtcagctctgatgtgcagtcggtgttcaaggggaagacatacaaccagctgcaggtcatcttccagggcatcgagggcaaaatccgcgctggtggccccaacctggacatgggctactgggagagcctcctgcagcagcttcgtgcccacatggcacgggcccggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggcaggtgtcctcgggggcacagtaaaggggcttcggtgaagctggtggtcactccggggccgctgtctgggctgcagggccgcgggttcacgtcccacctcaggccgcatctttctttcgccaggcctcagtttcctcctatataaaaggggggtcaccattgagcctgccatggtgagctgaggagacactgggacaggctggcctagggtcctgatgcaacggagggggcgctaggggcatctttcgagcacgagggtggccagcagccgccagctgacctcaccgtccaggcggacactctccaccgcccctcagccaggctgggtggggcccacagggcctgccccaagtggcggccacacagggtgttgtggagatgggccagaggggcctgggcttggcggtgccaggctcgtgagaagcaggaaactcaaggccagccctgccacatcacggggcacccactgggcgtgaggcagagcccgcggctgtggggcagctccagccctgcccacaggccaccctcgcccgcacaggcagcactgaggccgggaccctgctggcgcccgatccgccactgcagaagagaccctctgtggacacccacactctgcagggactggcccccaactcaccccgtgctggctggtggggtccatttccccgcagcgggtatggaggatgcgtcgaggtccctgtctctgtcaaggtcgtgggaaccaaaagtcactgagccgtcctccccccacctctgagcacagggcctggagggcaggggctccccgaaggctgggggttggagaagggtgaggggcttcccccagggatccccccacctggcctgctcacggggccttggagcatgagaccagtgaccccgagttttgcccatatcaggacagtggctccttctcactcccctttctcaggccaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgttgtattttagaataatctt

SEQ ID NO: 112736 - DNA, 699 bp, Homo sapiens
  Payload ID: 2062
  Gene Symbol: CACTIN
  Gene Name: cactin, spliceosome C complex subunit
  ENST ID: ENST00000591726
  CDS Start-End: 1-354
aagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggcaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgttgtattttagaataa

SEQ ID NO: 112737 - DNA, 2810 bp, Homo sapiens
  Payload ID: 2062
  Gene Symbol: CACTIN
  Gene Name: cactin, spliceosome C complex subunit
  Uniprot ID: Q8WUQ7
  ENST ID: ENST00000585942
  CDS Start-End: 54-2330
cccagcgcaggcttcggctattggtgttggtgccgcggccactggcccagccgatgggtcgggacacacgctcgcgctcgcggtccgcgggtcgccggggccgaaggcggcagagtcagagcgggagccgaagtcggagcaggagccatgggcggcgaaaccgacggcgccgggaggacgagggacggcgcagacggaggcggcggagccgggagcgcaggtcagattcagaggaagagcggtggcagcgctcagggatgcgaagccggagccccccgcggcccaagtggcactcaagagatgggtcctctcagtcggactcaggagaggagcagtcacggggccagtgggctcgccggcgacggcgcgcacgctcgtggtctcctagctcctcagcatccagctccgcgtctccagggcgatcccagagcccccgggcggccgcggctgccctgagccagcagcagagcctgcaggagcggctgcggctgcgggaggagcggaagcagcaggaggagctgatgaaggccttcgagacgcccgaggagaagcgcgcacggcggctggccaagaaggaggccaaggagcgcaagaagcgggagaagatgggctggggtgaggagtacatgggctacaccaacaccgacaaccccttcggagacaacaacctgctgggcaccttcatctggaataaggccctggagaagaaggggatcagccacctggaggagaaggagctgaaggagcggaacaagaggatccaggaggacaaccggctggagctgcagaaggtgaagcagctgcggctggagcgggagcgggagaaggccatgcgcgagcaggagctggagatgctgcagcgcgagaaggaggcagagcacttcaagacatgggaggagcaggaggacaacttccacctccagcaggccaagctgcgttccaagatccgcatccgggacgggcgggccaagcccatcgacctgctggccaagtacatcagcgctgaggatgacgatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccaggtgagcgccgcgagggggtcaacgcctccgtcagctctgatgtgcagtcggtgttcaaggggaagacatacaaccagctgcaggtcatcttccagggcatcgagggcaaaatccgcgctggtggccccaacctggacatgggctactgggagagcctcctgcagcagcttcgtgcccacatggcacgggcccggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggcagcactgaggccgggaccctgctggcgcccgatccgccactgcagaagagaccctctgtggacacccacactctgcagggactggcccccaactcaccccgtgctggctggtggggtccatttccccgcagcgggccaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgttgtattttagaat

SEQ ID NO: 112738 - DNA, 1708 bp, Homo sapiens
  Payload ID: 2062
  Gene Symbol: CACTIN
  Gene Name: cactin, spliceosome C complex subunit
  ENST ID: ENST00000589321
  CDS Start-End: 1-424
caagtacatcagcgctgaggatgacgatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccaggtgagcgccgcgagggggtcaacgcctccgtcagctctgatgtgcagtcggtgttcaaggggaagacatacaaccagctgcaggtcatcttccagggcatcgagggcaaaatccgcgctggtggccccaacctggacatgggctactgggagagcctcctgcagcagcttcgtgcccacatggcacgggcccggtgagcactaggctgcgtgagcgccaccaggacgtgctgcggcagaagctgtacaaactgaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggcaggtgtcctcgggggcacagtaaaggggcttcggtgaagctggtggtcactccggggccgctgtctgggctgcagggccgcgggttcacgtcccacctcaggccgcatctttctttcgccaggcctcagtttcctcctatataaaaggggggtcaccattgagcctgccatggtgagctgaggagacactgggacaggctggcctagggtcctgatgcaacggagggggcgctaggggcatctttcgagcacgagggtggccagcagccgccagctgacctcaccgtccaggcggacactctccaccgcccctcagccaggctgggtggggccc

SEQ ID NO: 112739 - DNA, 1220 bp, Homo sapiens
  Payload ID: 2062
  Gene Symbol: CACTIN
  Gene Name: cactin, spliceosome C complex subunit
  ENST ID: ENST00000592721
  CDS Start-End: 1-874
gaagcaggagcagggcgtggagagcgagccgctgttccccatcctcaagcaggagccccagtcccccagccgcagcctggagcctgaggacgcggcgcccaccccgcccgggccctcctcggagggcggccccgcggaggccgaggtggacggcgcgaccccgacagagggcgacggcgacggggacggtgagggcgagggcgagggcgaggcggtgctcatggaggaggacctgatccagcagagcctggacgactacgacgccggcaggtacagcccgcggctgctcacggcgcacgagctgccactggacgcgcacgtgctggaaccggatgaggacctgcagcgcctgcagctctcgcgccagcagctccaggtcacgggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggccaggagggccgagggccacacgggtgccacagcccaggtcggagtggcccagccggcaggcttgttcttcagcatccgacgggaacatctccaacagaagcaaaacggaaagtgcctcccggacccccagagggccacccaacctcaccagtcaccagccccagaccacccacagcccctcccagacaccccgcctcatctggaaatagttccgtttgtttctctaaaaagacttgtaggtgggaaaaaaaatcttttgttctcatggaattggcctattggcaagatcgcatgtttttttaataaacgttgtattttagaataa

SEQ ID NO: 112740 - DNA, 391 bp, Homo sapiens
  Payload ID: 2062
  Gene Symbol: CACTIN
  Gene Name: cactin, spliceosome C complex subunit
  ENST ID: ENST00000588749
  CDS Start-End: 1-391
gatctggccgtggagatgcatgagccctacacgttcctcaacggcctcaccgtggccgacatggaggacctgctggaggatatccaggtctacatggagctggagcagggcaagaacgccgacttctggcgggacatgaccaccatcaccgaggacgagatctccaagctccgcaagctggaggcctcgggcaaggggccagggcatcgagggcaaaatccgcgctggtggccccaacctggacatgggctactgggagagcctcctgcagcagcttcgtgcccacatggcacgggcccggtgagcactaggctgcgtgagcgccaccaggacgtgctgcggcagaagctgtacaaactgaagcaggagcagggcgtggagagcgagccgc

SEQ ID NO: 112741 - DNA, 4889 bp, Homo sapiens
  Payload ID: 2063
  Gene Symbol: CDH1
  Gene Name: cadherin 1, type 1
  Uniprot ID: P12830
  ENST ID: ENST00000261769
  CDS Start-End: 192-2840
agccaatcagcggtacggggggcggtgcctccggggctcacctggctgcagccacgcaccccctctcagtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccattgtcaaa

SEQ ID NO: 112742 - DNA, 2567 bp, Homo sapiens
  Payload ID: 2063
  Gene Symbol: CDH1
  Gene Name: cadherin 1, type 1
  Uniprot ID: P12830
  ENST ID: ENST00000422392
  CDS Start-End: 65-2530
gctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctg

SEQ ID NO: 112743 - DNA, 4138 bp, Homo sapiens
  Payload ID: 2063
  Gene Symbol: CDH1
  Gene Name: cadherin 1, type 1
  ENST ID: ENST00000566612
  CDS Start-End: 105-1718
gcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacgttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaag

SEQ ID NO: 112744 - DNA, 2661 bp, Homo sapiens
  Payload ID: 2063
  Gene Symbol: CDH1
  Gene Name: cadherin 1, type 1
  ENST ID: ENST00000566510
  CDS Start-End: 65-1309
gctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaaggtttgtatggtacctggcaagatgcagaaactggcatcctcacagctgttcatacccttgtcccctgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctg

SEQ ID NO: 112745 - DNA, 736 bp, Homo sapiens
  Payload ID: 2063
  Gene Symbol: CDH1
  Gene Name: cadherin 1, type 1
  ENST ID: ENST00000561751
  CDS Start-End: 1-466
cacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactgaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatc

SEQ ID NO: 112746 - DNA, 2068 bp, Homo sapiens
  Payload ID: 2063
  Gene Symbol: CDH1
  Gene Name: cadherin 1, type 1
  ENST ID: ENST00000612417
  CDS Start-End: 125-2068
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtggcaggattgcttgaacctagtgatcctcccatcttggcctcccagagtattgggattacagacatgagccactgcacctgcccagctccccaactccctgccattttttaa

SEQ ID NO: 112747 - DNA, 3304 bp, Homo sapiens
  Payload ID: 2063
  Gene Symbol: CDH1
  Gene Name: cadherin 1, type 1
  ENST ID: ENST00000621016
  CDS Start-End: 108-2051
aaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaacttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgtt

SEQ ID NO: 112748 - DNA, 4878 bp, Homo sapiens
  Payload ID: 2063
  Gene Symbol: CDH1
  Gene Name: cadherin 1, type 1
  ENST ID: ENST00000611625
  CDS Start-End: 125-2836
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaaggtatggtacctggcaagatgcagaaactggcatcctcacagctgttcatacccttgtcccctgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccat

SEQ ID NO: 112749 - DNA, 3438 bp, Homo sapiens
  Payload ID: 2064
  Gene Symbol: CDH10
  Gene Name: cadherin 10, type 2 (T2-cadherin)
  Uniprot ID: Q9Y6N8
  ENST ID: ENST00000264463
  CDS Start-End: 509-2875
acttgcaaatcgctgtgtgctcgcagaagccagcacttccacagtctctaaccttcccatggcgagtgctgcagctctatcagcagaacctttctctccgtgtgaggaagagcttttttcccccctttccttttttttttttttcctttccccttaatcagaagcactgaatgaaagccaatcagagagagctcgcccccgttttcttcggttccctgctgtccagagttaaaagtgatgctgagaaagagcttgagttagattgaagtagaatcagtgatagaaaataacagccgaaaacaaacaaaaaggggacatagtgacaatttctcctgggttattttggctggaaccaacttccattatccagaagctgataaaaaagctttgggaaacatgaacaaaacattgatgaaatgttggaaaccagttgaaacacagtaaaaccaactgggtaaaataggaccacttctcttcatctacactgggatttgtcaagaagtgaactatgacaatacatcaatttttgctactgtttctattctgggtatgcctgccacatttctgctctccagaaataatgttcagaaggacgcctgtgccacagcaaagaattttaagttcacgtgtaccaaggagtgatggcaaaattctccatcgtcaaaaacgtggttggatgtggaatcaatttttcttacttgaagaatatacaggatctgattatcagtacgtaggcaagctacattcagaccaagataaaggagatggatcactcaaatatatcttatctggagatggagctggtactctttttattattgatgaaaaaacaggtgatattcatgccacaaggcgaattgatagggaggaaaaggccttttatactctacgcgcacaagctattaacagaagaactctgaggccagtagagccagagtcagagtttgtgatcaaaattcatgatatcaatgacaatgagccaacgttcccagaagaaatctatacagctagtgttcccgaaatgtctgttgtaggtacttctgtggtgcaagtcacagctacagatgccgatgacccttcatatgggaacagcgccagagtcatttacagcatacttcaagggcagccctatttctctgtggagcctgaaacaggtatcatcaggactgctttaccgaacatgaacagagaaaacagagagcaataccaagtggtcatccaggccaaagacatgggcggccagatgggaggcttatcggggacaaccactgtgaacatcacgctgacagatgtcaatgacaacccaccacgtttcccccagaacactattcatcttcgagttcttgaatcctccccagttggcacagccattggaagtgtcaaagcaactgatgctgacactgggaaaaatgctgaagtagaataccgaattattgatggtgacggtactgatatgtttgacatcgtgactgagaaggacacacaggaaggcatcatcactgtgaaaaagccactcgactatgagagccgaagactttatactctgaaagtcgaagcagaaaacacccatgtagatccccgtttttattacctaggaccatttaaagatactaccatagtgaaaatctctatagaagatgtggatgaacctcctgtttttagtaggtcctcctatctgtttgaagttcatgaagatattgaagtgggcacaatcattggtactgtaatggcaagggacccagattctatttccagccccattagattttccttggatcgccatactgaccttgacagaatctttaacattcattcaggaaatggatctctttatacatcaaaacctcttgaccgtgaactatctcagtggcataatcttactgttattgctgctgaaatcaacaatcccaaagagacaacacgcgtggctgtttttgtgagaattttggatgttaatgacaatgccccacagtttgctgtgttctatgacacttttgtatgtgaaaatgccagaccagggcagctaatacagactataagtgcagtagacaaagatgaccctttaggtggacagaaattttttttcagtttagctgctgtcaatccaaacttcacagtacaggataatgaagataatactgccagaatcttaaccagaaaaaatggattcaatagacatgaaatcagtacctatctcttgcctgtggtgatatcagacaatgattacccaattcagagcagcacaggcacactgaccattcgagtgtgtgcttgtgacagccaaggcaacatgcaatcctgcagtgctgaagccctgctcctccctgccggcctcagcactggggccttgatcgccatcctcctctgcatcatcattctactggttatagtagtactgtttgcagctctgaaaagacagcgaaaaaaagagcctctgatcttgtcaaaagaagatatcagagacaacattgtgagctataacgatgagggtggtggagaggaggacacccaggcctttgatatcggcaccctgaggaatcctgcagccattgaggaaaaaaagctccggcgagatattattccagaaacgttatttattcctcggaggactcctacagctccagataacacggacgtccgggatttcattaatgaaaggctaaaagagcatgatcttgaccccaccgcacccccctacgactcacttgcaacctatgcctatgaaggaaatgattccattgctgaatctctgagttcattagaatcaggtactactgaaggagaccaaaactacgattacctccgagaatggggccctcggtttaataagctagcagaaatgtatggtggtggggaaagtgacaaagactcttaacgtaggatatatgttctgttcaaacaagagaaagtaactctacccatgctgtctccacttcacaatatttgatattcaggagcattttcctgccagtcagcacaattttttttctcatttacttcttaatttgttcattaattacattaattctttcctgtaggatgtctcatggaatatatatgacattttatttaatcacttccaagagccaaagctatggaaatacagtgttgtccatcttagtaaataaaagataatttcagaaacatgaacaggatagttctcccttaagcaacctcacaaacaagccgcttctgttaggtacatgtcctgcccttgcaaatgaagcttttaaaaaggtgaagaaaaattttacagtatatcctgttctgtacattaaattaaaaaaacaaaaatgtacatgtgatgttagtaggtgtgatatgcaacctggtatacagacatttgtgcaatttcatttcatcaaattctatctgctaatgttttatatttatatttttgtatttatttttaaaaaaataaaccagtttttacaacta

SEQ ID NO: 112750 - DNA, 2855 bp, Homo sapiens
  Payload ID: 2064
  Gene Symbol: CDH10
  Gene Name: cadherin 10, type 2 (T2-cadherin)
  ENST ID: ENST00000510477
  CDS Start-End: 311-1621
ccgttttcttcggttccctgctgtccagagttaaaagtgatgctgagaaagagcttgagttagattgaagtagaatcagtgatagaaaataacagccgaaaacaaacaaaaaggggacatagtgacaatttctcctgggttattttggctggaaccaacttccattatccagaagctgataaaaaagctttgggaaacatgaacaaaacattgatgaaatgttggaaaccagttgaaacacagtaaaaccaactgggtaaaataggaccacttctcttcatctacactgggatttgtcaagaagtgaactatgacaatacatcaatttttgctactgtttctattctgggtatgcctgccacatttctgctctccagaaataatgttcagaaggacgcctgtgccacagcaaagaattttaagttcacgtgtaccaaggagtgatggcaaaattctccatcgtcaaaaacgtggttggatgtggaatcaatttttcttacttgaagaatatacaggatctgattatcagtacgtaggcaagctacattcagaccaagataaaggagatggatcactcaaatatatcttatctggagatggagctggtactctttttattattgatgaaaaaacaggtgatattcatgccacaaggcgaattgatagggaggaaaaggccttttatactctacgcgcacaagctattaacagaagaactctgaggccagtagagccagagtcagagtttgtgatcaaaattcatgatatcaatgacaatgagccaacgttcccagaagaaatctatacagctagtgttcccgaaatgtctgttgtaggtacttctgtggtgcaagtcacagctacagatgccgatgacccttcatatgggaacagcgccagagtcatttacagcatacttcaagggcagccctatttctctgtggagcctgaaacaggtatcatcaggactgctttaccgaacatgaacagagaaaacagagagcaataccaagtggtcatccaggccaaagacatgggcggccagatgggaggcttatcggggacaaccactgtgaacatcacgctgacagatgtcaatgacaacccaccacgtttcccccagaacactattcatcttcgagttcttgaatcctccccagttggcacagccattggaagtgtcaaagcaactgatgctgacactgggaaaaatgctgaagtagaataccgaattattgatggtgacggtactgatatgtttgacatcgtgactgagaaggacacacaggaaggcatcatcactgtgaaaaagccactcgactatgagagccgaagactttatactctgaaagtcgaagcagaaaacacccatgtagatccccgtttttattacctaggaccatttaaagatactaccatagtgaaaatctctatagaagatgtggatgaacctcctgtttttagtaggtcctcctatctgtttgaagttcatgaagatattgaagtgggcacaatcattggtactgtaatggcaagggacccagattctatttccagccccattagacaatcccaaagagacaacacgcgtggctgtttttgtgagaattttggatgttaatgacaatgccccacagtttgctgtgttctatgacacttttgtatgtgaaaatgccagaccagggcagctaatacagactataagtgcagtagacaaagatgaccctttaggtggacagaaattttttttcagtttagctgctgtcaatccaaacttcacagtacaggataatgaagataatactgccagaatcttaaccagaaaaaatggattcaatagacatgaaatcagtacctatctcttgcctgtggtgatatcagacaatgattacccaattcagagcagcacaggcacactgaccattcgagtgtgtgcttgtgacagccaaggcaacatgcaatcctgcagtgctgaagccctgctcctccctgccggcctcagcactggggccttgatcgccatcctcctctgcatcatcattctactggttatagtagtactgtttgcagctctgaaaagacagcgaaaaaaagagcctctgatcttgtcaaaagaagatatcagagacaacattgtgagctataacgatgagggtggtggagaggaggacacccaggcctttgatatcggcaccctgaggaatcctgcagccattgaggaaaaaaagctccggcgagatattattccagaaacgttatttattcctcggaggactcctacagctccagataacacggacgtccgggatttcattaatgaaaggctaaaagagcatgatcttgaccccaccgcacccccctacgactcacttgcaacctatgcctatgaaggaaatgattccattgctgaatctctgagttcattagaatcaggtactactgaaggagaccaaaactacgattacctccgagaatggggccctcggtttaataagctagcagaaatgtatggtggtggggaaagtgacaaagactcttaacgtaggatatatgttctgttcaaacaagagaaagtaactctacccatgctgtctccacttcacaatatttgatattcaggagcattttcctgccagtcagcacaattttttttctcatttacttcttaatttgttcattaattacattaattctttcctgtaggatgtctcatggaatatatatgacattttatttaatcacttccaagagccaaagctatggaaatacagtgttgtccatcttagtaaataaaagataatttcagaaacatgaacaggatagttctcccttaagcaacctcacaaacaagccgc

SEQ ID NO: 112751 - DNA, 6857 bp, Homo sapiens
  Payload ID: 2065
  Gene Symbol: CDH11
  Gene Name: cadherin 11, type 2, OB-cadherin (osteoblast)
  Uniprot ID: P55287
  ENST ID: ENST00000268603
  CDS Start-End: 617-3007
ttctctcagcccccgccctttccttccctcacagcggcagcctccctcctcccgccccccccgccccgcacccgcctgcccgcccgccacctccccccggtttctcattcctgccactagcgcgctcggcggctcattccgcggccgccgccagctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacgtataaatatcagtattctgacatgtaagaaaatgttacggcatcacacttatattttatgaacattgtactgttgctttaatatgagcttcaatataagaagcaatctttgaaataaaaaaagatttttttttaattctgggtttgattcttaacattgaaacaaacgttaagtatttctaatgatccatttatatttctaatttaattgtgatcttttaataaccctatttatgatctgttgttgtctgtctgctgcttttattgtttatttaaaatcaaatatgttttacaaatgttttttcagacaagattctgtaacatcatgtaaagcttttttgtacattcttggtgttaacctcctggcttctcttcacacacatcttctaaaaaagaaggatgtgaaagaactaggtcagtctatgactttgcaatatgtgttatatagtatgcatttatcttgtatatcagtaatttgatggttatgagagatgaatccatgagggaatggagctatcagaactctaatgttccaggtatacattctatgccccacactgagcactggggaactgggggactagagtcaaaaatataaatttgcccagactctaatgttattctattttttcttctgttgaacttaccaggctattgtaagactcttgatagttgaaactgcttatttttcctcctgtaattttaactaattgtaaaatgatgtggcattttatgttttaatgagaatgggcgattcatttaaaaaagctttgtttagaatatgcttggggccgtaagctcagaatgagggcagggaccattttggattctgagagtcgatgccatttggtccaggagtgtgtctacagtcccctgcattccagctagtttcttggggattgaaacttatgtgaagggcatttcacctgttcagttgggccaaaggtcaaaacgtagcaatacttggggaaagaccacataaagtcacactgcaagtgctttccctctttccccctacacacagggcacgtgctttttcttggattgcagacaatttttacagtttttttctgactttattgtgaaagtttgtttcaagcatttcttgatatcatgttatgtactatttttatgatttagtcaacatgcatacaaagaaatgttttttatgaagtgctcacttccattttactttgcattgaaatcaaattgggctgaacacttcaatggaatacattttgtggacaatgtcactttagaatctttcatctcagtgaaggattacacattctcaatacttccataattgcaggttgtgttcatttttttatatagtttttgtaatccaaagaatattttgctagatttgcacagatctccaattgaatttgcaatgaagaaataactcaaaaggaatatgaatagcatttaaataagtatacagctgtaagtaaccctgtcaccatggatgatccttttctctaggaatgtatttggattagagatgacaactacattttcgcatttttatgttgaagtcttttttaaaaaggctgtttacttttcagtagttaagaatacttgtttttctttttcttttttttttttttttttaccttttattttttcgttaagcctctattgtttgtagaacactcttagaaacttggaaataaaatgtctttcccaactagtggagtcctttttcatttggagcacattgccttaaaagaagtcttaatttaaacggtccttccttattctaaagtaatcactgttttataccatctatgcagctaaaagaaggaacatgcttctgttcttttcctcaagtaatggttattgtttctagtcatcattcattcattgattcattcattaattcatcaaaatcttattttataaaccctgttccacttactggaggattcagaatgaatcttactaccttttctgacatcttttgataattcagccctgtaccaaagtatccaccttgttgtcttataatcacctatttacctatttgccctcctagaaaatgcaagaagatattttctctccttccaaattgaaggaagaacataaaagatataacaggaaggagatggtgagatatagagtgtgagcggaaattaggccagctgtggcaattctggacagatcttgggtttagctaagttatttcttttaggcctgggtttctgggggtgacagggaagataaaagagtagtttatttgcacctcttggagaattgcttaaaaatatagagatcatggctctgtatgtcaggtggaaccaggtcaggagtatttgaaactgctcctgggtcattgtgacatatccttcacatctttttgagaaactttataagacaatgggggtgaatgggggctgggcagttggagtctctgagcagaagaggggcaaaatttatttggcaggcagtgtggaggacagattaggagcatataaacccagaggtgtgccccaggagggcttttgcaaaggtcaatatgagatagaatgagggcctgaaataattcagtaatttggagatggagaagaggaaagacttctctgctcttgcactgccatcagcctggtctgggccatggtcatctctgacccggaagactgaccccacctcttggctcaccctctgcctcccaacctcctcttcacaaagaagccagagggatacttttaacacacaacccagatcacatgacttcgtaacttaaacctcttcactggcttcccaaagacttaaaatgaattctgatgcctttattttattgctttacatgaacagggccctgcgaacctctccagtgtcattccactccatcctcctttcagtgcacgatgctccagccacactggccatctttcggttcctgatacaaaaaaaaacacgttccttttccatggaaagcaggtcacccttgttattttgtatcgatgacaactctttaaacttattttgctttttggctttatgtatgtgtgtgggtgggtgggactgactgccccactagaatgtaagctccatgagggcagggaatcttgctttcttgtttaccattgtatactcagttctttacacagtgcctgaaacataacaggtacacaataaatatctattgaatgaaagcaaa

SEQ ID NO: 112752 - DNA, 6874 bp, Homo sapiens
  Payload ID: 2065
  Gene Symbol: CDH11
  Gene Name: cadherin 11, type 2, OB-cadherin (osteoblast)
  Uniprot ID: P55287
  ENST ID: ENST00000394156
  CDS Start-End: 455-2536
agcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctgggttgcccaagcttaatggaacccccctctcccagggaagacatgagattgctttatctgggcttccagctgatgctattttcctatgttaaagtaaacagaagattttgtcttctgggggtctttataaaacttcctttcctctatgtggtggctacagagagtccaaccacacttacgtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacgtataaatatcagtattctgacatgtaagaaaatgttacggcatcacacttatattttatgaacattgtactgttgctttaatatgagcttcaatataagaagcaatctttgaaataaaaaaagatttttttttaattctgggtttgattcttaacattgaaacaaacgttaagtatttctaatgatccatttatatttctaatttaattgtgatcttttaataaccctatttatgatctgttgttgtctgtctgctgcttttattgtttatttaaaatcaaatatgttttacaaatgttttttcagacaagattctgtaacatcatgtaaagcttttttgtacattcttggtgttaacctcctggcttctcttcacacacatcttctaaaaaagaaggatgtgaaagaactaggtcagtctatgactttgcaatatgtgttatatagtatgcatttatcttgtatatcagtaatttgatggttatgagagatgaatccatgagggaatggagctatcagaactctaatgttccaggtatacattctatgccccacactgagcactggggaactgggggactagagtcaaaaatataaatttgcccagactctaatgttattctattttttcttctgttgaacttaccaggctattgtaagactcttgatagttgaaactgcttatttttcctcctgtaattttaactaattgtaaaatgatgtggcattttatgttttaatgagaatgggcgattcatttaaaaaagctttgtttagaatatgcttggggccgtaagctcagaatgagggcagggaccattttggattctgagagtcgatgccatttggtccaggagtgtgtctacagtcccctgcattccagctagtttcttggggattgaaacttatgtgaagggcatttcacctgttcagttgggccaaaggtcaaaacgtagcaatacttggggaaagaccacataaagtcacactgcaagtgctttccctctttccccctacacacagggcacgtgctttttcttggattgcagacaatttttacagtttttttctgactttattgtgaaagtttgtttcaagcatttcttgatatcatgttatgtactatttttatgatttagtcaacatgcatacaaagaaatgttttttatgaagtgctcacttccattttactttgcattgaaatcaaattgggctgaacacttcaatggaatacattttgtggacaatgtcactttagaatctttcatctcagtgaaggattacacattctcaatacttccataattgcaggttgtgttcatttttttatatagtttttgtaatccaaagaatattttgctagatttgcacagatctccaattgaatttgcaatgaagaaataactcaaaaggaatatgaatagcatttaaataagtatacagctgtaagtaaccctgtcaccatggatgatccttttctctaggaatgtatttggattagagatgacaactacattttcgcatttttatgttgaagtcttttttaaaaaggctgtttacttttcagtagttaagaatacttgtttttctttttcttttttttttttttttttaccttttattttttcgttaagcctctattgtttgtagaacactcttagaaacttggaaataaaatgtctttcccaactagtggagtcctttttcatttggagcacattgccttaaaagaagtcttaatttaaacggtccttccttattctaaagtaatcactgttttataccatctatgcagctaaaagaaggaacatgcttctgttcttttcctcaagtaatggttattgtttctagtcatcattcattcattgattcattcattaattcatcaaaatcttattttataaaccctgttccacttactggaggattcagaatgaatcttactaccttttctgacatcttttgataattcagccctgtaccaaagtatccaccttgttgtcttataatcacctatttacctatttgccctcctagaaaatgcaagaagatattttctctccttccaaattgaaggaagaacataaaagatataacaggaaggagatggtgagatatagagtgtgagcggaaattaggccagctgtggcaattctggacagatcttgggtttagctaagttatttcttttaggcctgggtttctgggggtgacagggaagataaaagagtagtttatttgcacctcttggagaattgcttaaaaatatagagatcatggctctgtatgtcaggtggaaccaggtcaggagtatttgaaactgctcctgggtcattgtgacatatccttcacatctttttgagaaactttataagacaatgggggtgaatgggggctgggcagttggagtctctgagcagaagaggggcaaaatttatttggcaggcagtgtggaggacagattaggagcatataaacccagaggtgtgccccaggagggcttttgcaaaggtcaatatgagatagaatgagggcctgaaataattcagtaatttggagatggagaagaggaaagacttctctgctcttgcactgccatcagcctggtctgggccatggtcatctctgacccggaagactgaccccacctcttggctcaccctctgcctcccaacctcctcttcacaaagaagccagagggatacttttaacacacaacccagatcacatgacttcgtaacttaaacctcttcactggcttcccaaagacttaaaatgaattctgatgcctttattttattgctttacatgaacagggccctgcgaacctctccagtgtcattccactccatcctcctttcagtgcacgatgctccagccacactggccatctttcggttcctgatacaaaaaaaaacacgttccttttccatggaaagcaggtcacccttgttattttgtatcgatgacaactctttaaacttattttgctttttggctttatgtatgtgtgtgggtgggtgggactgactgccccactagaatgtaagctccatgagggcagggaatcttgctttcttgtttaccattgtatactcagttctttacacagtgcctgaaacataacaggtacacaataaatatctattgaatgaaagcaaa

SEQ ID NO: 112753 - DNA, 613 bp, Homo sapiens
  Payload ID: 2065
  Gene Symbol: CDH11
  Gene Name: cadherin 11, type 2, OB-cadherin (osteoblast)
  ENST ID: ENST00000562712
  CDS Start-End: 453-613
tttatggtggcagcacaatgggcctttcagggctcagggaaagagctgtgagatcctgctccccggcttttcaaggcctctagtctttttatcaggcctggacaatgccggattcagcggctgcctgagcctcctgaccgtccattggccgtcagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtgg

SEQ ID NO: 112754 - DNA, 568 bp, Homo sapiens
  Payload ID: 2065
  Gene Symbol: CDH11
  Gene Name: cadherin 11, type 2, OB-cadherin (osteoblast)
  ENST ID: ENST00000562998
  CDS Start-End: 359-568
tcattccgcggccgccgccagctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgac

SEQ ID NO: 112755 - DNA, 569 bp, Homo sapiens
  Payload ID: 2065
  Gene Symbol: CDH11
  Gene Name: cadherin 11, type 2, OB-cadherin (osteoblast)
  ENST ID: ENST00000562882
  CDS Start-End: 466-569
aaagctgggctgagccctctcacggtcctgtggcccttggtctccccacatgaggtgtcccgagattgaagagagaaggtgcctcctggcattgccaaggctggaatctgcctgtcaaggaagtccctcggcggctagctgctgcaccatgaccttcgtgatggtggaaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctcctt

SEQ ID NO: 112756 - DNA, 1235 bp, Homo sapiens
  Payload ID: 2065
  Gene Symbol: CDH11
  Gene Name: cadherin 11, type 2, OB-cadherin (osteoblast)
  ENST ID: ENST00000567934
  CDS Start-End: 570-1235
gctggcagtgccagggatcaggagccgcctctccgtctgtccagaacaaagctgggctgagccctctcacggtcctgtggcccttggtctccccacatgaggtgtcccgagattgaagagagaaggtgcctcctggcattgccaaggctggaatctgcctgtcaaggaagtccctcggcggctagctgctgcaccatgaccttcgtgatggtggagtgagtaggcactggaatcaataagcctggcctctccatctgccagcctgaatgcagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctaccc

SEQ ID NO: 112757 - DNA, 582 bp, Homo sapiens
  Payload ID: 2065
  Gene Symbol: CDH11
  Gene Name: cadherin 11, type 2, OB-cadherin (osteoblast)
  ENST ID: ENST00000562325
  CDS Start-End: 516-582
attcctgccactagcgcgctcggcggctcattccgcggccgccgccagctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccaggtgagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcct

SEQ ID NO: 112758 - DNA, 566 bp, Homo sapiens
  Payload ID: 2065
  Gene Symbol: CDH11
  Gene Name: cadherin 11, type 2, OB-cadherin (osteoblast)
  ENST ID: ENST00000564317
  CDS Start-End: 370-566
agactccatctgagccctgagggagtcggagcgccgcgccacggggcgggaggggcggccacgaatccagggaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagta

SEQ ID NO: 112759 - DNA, 2395 bp, Homo sapiens
  Payload ID: 2065
  Gene Symbol: CDH11
  Gene Name: cadherin 11, type 2, OB-cadherin (osteoblast)
  ENST ID: ENST00000566827
  CDS Start-End: 327-2339
tgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctag

SEQ ID NO: 112760 - DNA, 3639 bp, Homo sapiens
  Payload ID: 2065
  Gene Symbol: CDH11
  Gene Name: cadherin 11, type 2, OB-cadherin (osteoblast)
  ENST ID: ENST00000619158
  CDS Start-End: 1-187
gatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaaggtgagttagggtaaggaatcagacgtgtcagtggtatggcctgctctgccaaggcaacactgcaagaaacagggaggcgacggttaagaaatgagaatttgcgaaaccaggggctgacctgactttgtagttgagctctgagctctggaagatcacagaattgtattcctttctgttactgcagagaagctgacaaaggggctggtgatacctgcctgagattgctagttagttcttaaatgttttccgatggagggaagcacagttctcccatggagggaaggacaatgagataaatctagattttgaagaagcagccctgagcatgcatggaattccccccttagctctgccacactgaatctgttagataagctgttcagaactcttactgtttcaacattcaagattcactgcattgctggaccctctgtgaaactgaagccttctctacttgtttttatctcaagtgaacctggagaagcaacaataatggaccttctcccctagtcaaagagcctgtggacctcccctcatagtcagtctccaaaaacatgtatctggaattaatttattacaaagagaagtttagtgtttcttcttttttacatgcgctcaatactgactactggccagacacagcaccatcctcttacaaacatcatttcatttacttttcacaaaaacaaacaaaagtatgaagtaggtagtgttatcccaatgggcaaagagacctcaacttaattttgaggagattggggctcagacagatgaaatcatttgacccagtcactgtcatatagctcaggcatgccgacctggaattcacaccttagttattctagaacaacttccctctcaagacattttgaaaacagctggcctggaaagcgtttgtaaagaagagccagataagattcacttccaagtgaagaaataattcccgtacattctaaaaaggtttccccccgtgatttaccacttgagaaatcaacacctctccatcatgaaagtgtatggagcattaaatcggaattggaagatgggattaccttggttttaatcaagcgttcattttcaacttagttttatagcatgaatattaaactccttggtgcgatggaaaagactggactctaacactgatagaaaattaatttgaagcatcaataaagaggccagtagctaaagaggagggaaggaccagtgggggaagacaggtcctgaaaggaatctttcaggtgggggagcaaggagtgacctgtgctaagaaactgacctttcacagacttttaaagtatgttggggttggggaaaatattatagagcacaaaacaaagaaaaggtagggggtgattgttataaaaaaagaaagaaaatgaaggatatggaaattggggtgaaatttggatacttggaaaagtctacattaatggatgaatggtaggaccgaggaagcctaattatcaaccacagggagctagggcagtcactaattctggtttctcctctggaaaagtagctgtgtgaattgtgtgttgcctagagctgtcaacttacttcgttaattaatattactatctcttctgcttgacactgacatatgaacattgacatcagcaattcctgcctcccatcctttgctgttcatgtaattgggtagttggttatgctaaggttgtcacctgtttttagtgtattcagggcataaacacacactgtatctctgaaatcctgaaacatttaaatcacccccatggaactcacacgtcgcaaatgagctctctgcatatgattaatttgcacatttgcctccaattcagtgtgtttattctaggcaaaggaataatcttctataaagcactgatgcttaggttttaaatagtgtaagatgttattgcatttgtaaaagaacatttgctcaaacttctagcacaaagttccaaatgtccaccgggggaaaaaaaagaaaaattatagatgaatttaacagagtaaaaatatgactccttgtgaaagtcattccatgcaatttaatactgtaaaagtctatagagacattatggcaatatttctgcattttaaagtattttttaacttagtgtttttatttatttcctaatttattcacccatttttccaccaagagttattgagttcttactatttgtcaggcaggccctttgccagaggctggaaatctaaagttgaagaggcagagtcttgaccacagggagttcacaatttaacaggacagtgaagtgatacaataattaaaaccgagagggttttctcagccttagcagtgttgatgtctagggctggataattctttgttgtaggaggctgttctgcgcattgtaggatatttggtagtatctagtatcccaggcttcccctcactaaaggtcattaagcacgtgctctaccccacccaacagtcctgataataataataaaaataattactctagacattgcctaatagccctggagtaactgggagcaaaatcactccccagttgaaaattgactgcaatagtgtgataaggcctatgcacatgggacatgaatgacttcttgtgggggcagttctcaagctgagtcttgatagatgaggagaaatttgctggatagttaaggacagaaaaggcagaaaaaataactcatgatgggctagtatcaatggaaacaggacacatttaagaaactgcaataccttcaatcttgagaatcttaagatatatacggtaaaaccaacaaacaaacttgttaaaattcaagggagatgttacaaagaattgaagaaggtagaagaggtagtgagatagtagtgaaggagaagaattcaagaaataattactagatagaatcattcatttattgaatattttagaaaacaataaatacctcttgagttctgactgtgtcttagtttaatagtgcacaggaaagagagaaactacccttggggtatttggacaatctctgtgtggttagctgaggaagaaccagggtcaaataaagatgaggttttaggtggcttcgtggacttagaggggaaaatccaatctgttcacgcagcacctttgactaaatgggaatcccatctatctcagagaaatcaccgcacagtgtctgagctatttattttcaaccagataaactccttgaaaagcagtgtcagagcagaattataaggcatttttaatattccctgttttaataaaactctttttatgtttgatttttctttatattctttgtccgcacgtatatagatgtggatacataacatttaacacggttgcaatcagagggtgatctgatttgttaacttaatgtcacatcataaacattttacatgctgttatataatgtacataatcatttttaatgactacataacatcccatcctattgacgaatcattatgtccttaataaaatctcacagttgga

SEQ ID NO: 112761 - DNA, 4164 bp, Homo sapiens
  Payload ID: 2066
  Gene Symbol: CDH12
  Gene Name: cadherin 12, type 2 (N-cadherin 2)
  Uniprot ID: P55289
  ENST ID: ENST00000382254
  CDS Start-End: 1088-3472
cgcctaatcttcacccgctgctaggctcgtttaatgagtcttctgagagctaaggagtcctcggattcattcaaagcattctacaatgaacgctaggggggaaaaagaacaaacaaaatacatttcaaatataggattcaattacttttcactactcaatgatgtgtcaaaggcacgctgtgttttgttttgagggcggggagatgacaggagggaatcctgggcccccattggctcgccgctcgccgctgcagttgagctccagccgctccgagagcattattgatctgaagggtaaatgtggagggagccacagagaggggtccaggcttttctgagaagagaggcagcctcttccaggaagaaagtggtgtctactggctgcccggcctggagaaccttctttgaatgaaaacggacaaaatgcaaagcagtgtgttggcacagtgatttggaaaggggaaacagaagagaagggtctcaccttccgcgcaaggctgagctgttggcaccctgctgcggccgtcggtgctgctgctcctgcagctgccttttctgccatcagctttgttacctaacagcttggctcttttgggaaatatagacaagctggaacccaggagcagttgggagttttaaagaatgccagcctttttaaagctttgatgtccagtgctatagaatcaagttactgtggaggtcaaaacaatttgagatacataagctggccttagaaaataaattgcctctaacttacagtgaggagctcaacataacagggaaaaggagcacaggatgcagctacttggagggtgttgattgaaaacttcgatctccccaccccattcacggttgatttgacggatttctcacctcgttcacagagaaaatttcaattaaggcccctttagatggaatataatacagcagaagccttttcatcaaaaggattaatgcctgcatcatcatttctgcaataaaacaagaagctaagtggtggaggccacagacacctcaaacctggattccacaattctacgttaagtgttggagtttttattactctgctgtaggaaagcctttgccaatgcttacaaggaactgtttatccctgcttctctgggttctgtttgatggaggtctcctaacaccactacaaccacagccacagcagactttagccacagagccaagagaaaatgttatccatctgccaggacaacggtcacatttccaacgtgttaaacgtggctgggtatggaatcaattttttgtgctggaagaatacgtgggctccgagcctcagtatgtgggaaagctccattccgacttagacaagggagagggcactgtgaaatacaccctctcaggagatggcgctggcaccgtttttaccattgatgaaaccacaggggacattcatgcaataaggagcctagatagagaagagaaacctttctacactcttcgtgctcaggctgtggacatagaaaccagaaagcccctggagcctgaatcagaattcatcatcaaagtgcaggatattaatgataatgagccaaagtttttggatggaccttatgttgctactgttccagaaatgtctcctgtgggtgcatatgtactccaggtcaaggccacagatgcagatgacccgacctatggaaacagtgccagagtcgtttacagcattcttcagggacaaccttatttctctattgatcccaagacaggtgttattagaacagctttgccaaacatggacagagaagtcaaagaacaatatcaagtactcatccaagccaaggatatgggaggacagcttggaggattagccggaacaacaatagtcaacatcactctcaccgatgtcaatgacaatccacctcgattccccaaaagcatcttccacttgaaagttcctgagtcttcccctattggttcagctattggaagaataagagctgtggatcctgattttggacaaaatgcagaaattgaatacaatattgttccaggagatgggggaaatttgtttgacatcgtcacagatgaggatacacaagagggagtcatcaaattgaaaaagcctttagattttgaaacaaagaaggcatacactttcaaagttgaggcttccaaccttcaccttgaccaccggtttcactcggcgggccctttcaaagacacagctacggtgaagatcagcgtgctggacgtagatgagccaccggttttcagcaagccgctctacaccatggaggtttatgaagacactccggtagggaccatcattggcgctgtcactgctcaagacctggatgtaggcagcagtgctgttaggtacttcatagattggaagagtgatggggacagctactttacaatagatggaaatgaaggaaccatcgccactaatgaattactagacagagaaagcactgcgcagtataatttctccataattgcgagtaaagttagtaaccctttattgaccagcaaagtcaatatactgattaatgtcttagatgtaaatgaatttcctccagaaatatctgtgccatatgagacagccgtgtgtgaaaatgccaagccaggacagataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttagccatagttgtactgtatgtagcactgcgaaggcagaagaaaaaagacaccctgatgacctctaaagaagacatcagagacaacgtcatccattacgatgatgaaggaggtggggaggaagatacccaggctttcgacatcggggctctgagaaacccaaaagtgattgaggagaacaaaattcgcagggatataaaaccagactctctctgtttacctcgtcagagaccacccatggaagataacacagacataagggatttcattcatcaaaggctacaggaaaatgatgtggatccaactgccccaccatacgattcactggccacatatgcctacgaagggagtgggtccgtggcagagtccctcagctctatagactctctcaccacagaagccgaccaggactatgactatctgacagactggggaccccgctttaaagtcttggcagacatgtttggcgaagaagagagttataaccctgataaagtcacttaagggagtcgtggaggctaaaatacaaccgagaggggagatttttaaaaaagaaaaagaaacacaaatattaatagaaatctctctcacacacacacacacacacaaacacacacacacacacacacactctgggacaagattcctttgattacctggtttctagtaagttactaaattaatcatattgtcagttttggtttattctgccaacaagagatacatcctataatgtgtacttgctttgttttgttgttttgttttttcacaatcacactgagacaagctcaggcctattcaatacaatttactgacatgacaacctagaacgaagatagctatgtggcatcacggtggaagagtgttagatttttcttaattccactaaagtgcctattgaaactcttatcatttaaagtggtgtacagtacactctgctgtgatggtattgcgggattcagagataaagacataaaacaaagacaccgtctttatgtcaagaagcaatagcgacactctgactctcctcattccttttgagaacaaaagaagaacactttctgatctccaccttcttctaattcaaaaggttttctttttcttttttaaactgtatgctaaaacgtatttgtttatcctatcctttcagaaaattgaaataaatatgaaaatatcaagttcaatatgtaagtccc

SEQ ID NO: 112762 - DNA, 4160 bp, Homo sapiens
  Payload ID: 2066
  Gene Symbol: CDH12
  Gene Name: cadherin 12, type 2 (N-cadherin 2)
  Uniprot ID: P55289
  ENST ID: ENST00000504376
  CDS Start-End: 712-3096
attgatctgaagggtaaatgtggagggagccacagagaggggtccaggcttttctgagaagagaggcagcctcttccaggaagaaagtggtgtctactggctgcccggcctggagaaccttctttgaatgaaaacggacaaaatgcaaagcagtgtgttggcacagtgatttggaaaggggaaacagaagagaagggtctcaccttccgcgcaaggctgagctgttggcaccctgctgcggccgtcggtgctgctgctcctgcagctgccttttctgccatcagctttgttacctaacagcttggctcttttgggaaatatagacaagctggaacccaggagcagttgggagttttaaagaatgccagcctttttaaagacagtgaggagctcaacataacagggaaaaggagcacaggatgcagctacttggagggtgttgattgaaaacttcgatctccccaccccattcacggttgatttgacggatttctcacctcgttcacagagaaaatttcaattaaggcccctttagatggaatataatacagcagaagccttttcatcaaaaggattaatgcctgcatcatcatttctgcaataaaacaagaagctaagtggtggaggccacagacacctcaaacctggattccacaattctacgttaagtgttggagtttttattactctgctgtaggaaagcctttgccaatgcttacaaggaactgtttatccctgcttctctgggttctgtttgatggaggtctcctaacaccactacaaccacagccacagcagactttagccacagagccaagagaaaatgttatccatctgccaggacaacggtcacatttccaacgtgttaaacgtggctgggtatggaatcaattttttgtgctggaagaatacgtgggctccgagcctcagtatgtgggaaagctccattccgacttagacaagggagagggcactgtgaaatacaccctctcaggagatggcgctggcaccgtttttaccattgatgaaaccacaggggacattcatgcaataaggagcctagatagagaagagaaacctttctacactcttcgtgctcaggctgtggacatagaaaccagaaagcccctggagcctgaatcagaattcatcatcaaagtgcaggatattaatgataatgagccaaagtttttggatggaccttatgttgctactgttccagaaatgtctcctgtgggtgcatatgtactccaggtcaaggccacagatgcagatgacccgacctatggaaacagtgccagagtcgtttacagcattcttcagggacaaccttatttctctattgatcccaagacaggtgttattagaacagctttgccaaacatggacagagaagtcaaagaacaatatcaagtactcatccaagccaaggatatgggaggacagcttggaggattagccggaacaacaatagtcaacatcactctcaccgatgtcaatgacaatccacctcgattccccaaaagcatcttccacttgaaagttcctgagtcttcccctattggttcagctattggaagaataagagctgtggatcctgattttggacaaaatgcagaaattgaatacaatattgttccaggagatgggggaaatttgtttgacatcgtcacagatgaggatacacaagagggagtcatcaaattgaaaaagcctttagattttgaaacaaagaaggcatacactttcaaagttgaggcttccaaccttcaccttgaccaccggtttcactcggcgggccctttcaaagacacagctacggtgaagatcagcgtgctggacgtagatgagccaccggttttcagcaagccgctctacaccatggaggtttatgaagacactccggtagggaccatcattggcgctgtcactgctcaagacctggatgtaggcagcagtgctgttaggtacttcatagattggaagagtgatggggacagctactttacaatagatggaaatgaaggaaccatcgccactaatgaattactagacagagaaagcactgcgcagtataatttctccataattgcgagtaaagttagtaaccctttattgaccagcaaagtcaatatactgattaatgtcttagatgtaaatgaatttcctccagaaatatctgtgccatatgagacagccgtgtgtgaaaatgccaagccaggacagataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttagccatagttgtactgtatgtagcactgcgaaggcagaagaaaaaagacaccctgatgacctctaaagaagacatcagagacaacgtcatccattacgatgatgaaggaggtggggaggaagatacccaggctttcgacatcggggctctgagaaacccaaaagtgattgaggagaacaaaattcgcagggatataaaaccagactctctctgtttacctcgtcagagaccacccatggaagataacacagacataagggatttcattcatcaaaggctacaggaaaatgatgtggatccaactgccccaccatacgattcactggccacatatgcctacgaagggagtgggtccgtggcagagtccctcagctctatagactctctcaccacagaagccgaccaggactatgactatctgacagactggggaccccgctttaaagtcttggcagacatgtttggcgaagaagagagttataaccctgataaagtcacttaagggagtcgtggaggctaaaatacaaccgagaggggagatttttaaaaaagaaaaagaaacacaaatattaatagaaatctctctcacacacacacacacacacaaacacacacacacacacacacactctgggacaagattcctttgattacctggtttctagtaagttactaaattaatcatattgtcagttttggtttattctgccaacaagagatacatcctataatgtgtacttgctttgttttgttgttttgttttttcacaatcacactgagacaagctcaggcctattcaatacaatttactgacatgacaacctagaacgaagatagctatgtggcatcacggtggaagagtgttagatttttcttaattccactaaagtgcctattgaaactcttatcatttaaagtggtgtacagtacactctgctgtgatggtattgcgggattcagagataaagacataaaacaaagacaccgtctttatgtcaagaagcaatagcgacactctgactctcctcattccttttgagaacaaaagaagaacactttctgatctccaccttcttctaattcaaaaggttttctttttcttttttaaactgtatgctaaaacgtatttgtttatcctatcctttcagaaaattgaaataaatatgaaaatatcaagttcaatatgtaagtcccaaattctagaaacaatgtttgatcttaacattagttcacattaaagctgttcattaaaatgttactttcttttccaaaaaaaaaagaaagaaaaaaaagaaaaaatattcctctttataaagagaggcctcagggctcaaattacacattaaaataaatattggttttgcttaatattgtactggtgtgtggaaaattggttttaacagtcaccagattcagcttttagtcatagatgtaatttcaagttgtgtttctatgaaaattcttagaagaaaaaagtgccattcatttaagcatggaaagagaaattcattatacagtttctcagagtttcttacaatctagtgattctttgatgagcagcaaaaa

SEQ ID NO: 112763 - DNA, 3028 bp, Homo sapiens
  Payload ID: 2066
  Gene Symbol: CDH12
  Gene Name: cadherin 12, type 2 (N-cadherin 2)
  Uniprot ID: P55289
  ENST ID: ENST00000522262
  CDS Start-End: 524-2788
tctttttatgttatttgcataattttatcctgcaaaagtgagagctgtcaaaaattaaccatttggggctttggcattcagttatgtgaccttttccagagagttagatctcttcagggaactaggaacttgatgaggaagtgctgagaaggtggtcagtggcagaaagagcggatgacggatggggaccagcagtgaggagctcaacataacagggaaaaggagcacaggatgcagctacttggagggtgttgattgaaaacttcgatctccccaccccattcacggttgatttgacggatttctcacctcgttcacagagaaaatttcaattaaggcccctttagatggaatataatacagcagaagccttttcatcaaaaggattaatgcctgcatcatcatttctgcaataaaacaagaagctaagtggtggaggccacagacacctcaaacctggattccacaattctacgttaagtgttggagtttttattactctgctgtaggaaagcctttgccaatgcttacaaggaactgtttatccctgcttctctgggttctgtttgatggaggtctcctaacaccactacaaccacagccacagcagactttagccacagagccaagagaaaatgttatccatctgccaggacaacggtcacatttccaacgtgttaaacgtggctgggtatggaatcaattttttgtgctggaagaatacgtgggctccgagcctcagtatgtgggaaagctccattccgacttagacaagggagagggcactgtgaaatacaccctctcaggagatggcgctggcaccgtttttaccattgatgaaaccacaggggacattcatgcaataaggagcctagatagagaagagaaacctttctacactcttcgtgctcaggctgtggacatagaaaccagaaagcccctggagcctgaatcagaattcatcatcaaagtgcaggatattaatgataatgagccaaagtttttggatggaccttatgttgctactgttccagaaatgtctcctgtgggtgttattagaacagctttgccaaacatggacagagaagtcaaagaacaatatcaagtactcatccaagccaaggatatgggaggacagcttggaggattagccggaacaacaatagtcaacatcactctcaccgatgtcaatgacaatccacctcgattccccaaaagcatcttccacttgaaagttcctgagtcttcccctattggttcagctattggaagaataagagctgtggatcctgattttggacaaaatgcagaaattgaatacaatattgttccaggagatgggggaaatttgtttgacatcgtcacagatgaggatacacaagagggagtcatcaaattgaaaaagcctttagattttgaaacaaagaaggcatacactttcaaagttgaggcttccaaccttcaccttgaccaccggtttcactcggcgggccctttcaaagacacagctacggtgaagatcagcgtgctggacgtagatgagccaccggttttcagcaagccgctctacaccatggaggtttatgaagacactccggtagggaccatcattggcgctgtcactgctcaagacctggatgtaggcagcagtgctgttaggtacttcatagattggaagagtgatggggacagctactttacaatagatggaaatgaaggaaccatcgccactaatgaattactagacagagaaagcactgcgcagtataatttctccataattgcgagtaaagttagtaaccctttattgaccagcaaagtcaatatactgattaatgtcttagatgtaaatgaatttcctccagaaatatctgtgccatatgagacagccgtgtgtgaaaatgccaagccaggacagataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttagccatagttgtactgtatgtagcactgcgaaggcagaagaaaaaagacaccctgatgacctctaaagaagacatcagagacaacgtcatccattacgatgatgaaggaggtggggaggaagatacccaggctttcgacatcggggctctgagaaacccaaaagtgattgaggagaacaaaattcgcagggatataaaaccagactctctctgtttacctcgtcagagaccacccatggaagataacacagacataagggatttcattcatcaaaggctacaggaaaatgatgtggatccaactgccccaccatacgattcactggccacatatgcctacgaagggagtgggtccgtggcagagtccctcagctctatagactctctcaccacagaagccgaccaggactatgactatctgacagactggggaccccgctttaaagtcttggcagacatgtttggcgaagaagagagttataaccctgataaagtcacttaagggagtcgtggaggctaaaatacaaccgagaggggagatttttaaaaaagaaaaagaaacacaaatattaatagaaatctctctcacacacacacacacacacaaacacacacacacacacacacactctgggacaagattcctttgattacctggtttctagtaagttactaaattaatcatattgtcagttttggtttattctgccaacaagagatacatcctataatgtgtacttgc

SEQ ID NO: 112764 - DNA, 3792 bp, Homo sapiens
  Payload ID: 2066
  Gene Symbol: CDH12
  Gene Name: cadherin 12, type 2 (N-cadherin 2)
  Uniprot ID: P55289
  ENST ID: ENST00000619694
  CDS Start-End: 535-2919
ttgtctttccagctttgttacctaacagcttggctcttttgggaaatatagacaagctggaacccaggagcagttgggagttttaaagaatgccagcctttttaaagctttgatgtccagtgctatagaatcaagttactgtggaggtcaaaacaatttgagatacataagctggccttagaaaataaattgcctctaacttacagtgaggagctcaacataacagggaaaaggagcacaggatgcagctacttggagggtgttgattgaaaacttcgatctccccaccccattcacggttgatttgacggatttctcacctcgttcacagagaaaatttcaattaaggcccctttagatggaatataatacagcagaagccttttcatcaaaaggattaatgcctgcatcatcatttctgcaataaaacaagaagctaagtggtggaggccacagacacctcaaacctggattccacaattctacgttaagtgttggagtttttattactctgctgtaggaaagcctttgccaatgcttacaaggaactgtttatccctgcttctctgggttctgtttgatggaggtctcctaacaccactacaaccacagccacagcagactttagccacagagccaagagaaaatgttatccatctgccaggacaacggtcacatttccaacgtgttaaacgtggctgggtatggaatcaattttttgtgctggaagaatacgtgggctccgagcctcagtatgtgggaaagctccattccgacttagacaagggagagggcactgtgaaatacaccctctcaggagatggcgctggcaccgtttttaccattgatgaaaccacaggggacattcatgcaataaggagcctagatagagaagagaaacctttctacactcttcgtgctcaggctgtggacatagaaaccagaaagcccctggagcctgaatcagaattcatcatcaaagtgcaggatattaatgataatgagccaaagtttttggatggaccttatgttgctactgttccagaaatgtctcctgtgggtgcatatgtactccaggtcaaggccacagatgcagatgacccgacctatggaaacagtgccagagtcgtttacagcattcttcagggacaaccttatttctctattgatcccaagacaggtgttattagaacagctttgccaaacatggacagagaagtcaaagaacaatatcaagtactcatccaagccaaggatatgggaggacagcttggaggattagccggaacaacaatagtcaacatcactctcaccgatgtcaatgacaatccacctcgattccccaaaagcatcttccacttgaaagttcctgagtcttcccctattggttcagctattggaagaataagagctgtggatcctgattttggacaaaatgcagaaattgaatacaatattgttccaggagatgggggaaatttgtttgacatcgtcacagatgaggatacacaagagggagtcatcaaattgaaaaagcctttagattttgaaacaaagaaggcatacactttcaaagttgaggcttccaaccttcaccttgaccaccggtttcactcggcgggccctttcaaagacacagctacggtgaagatcagcgtgctggacgtagatgagccaccggttttcagcaagccgctctacaccatggaggtttatgaagacactccggtagggaccatcattggcgctgtcactgctcaagacctggatgtaggcagcagtgctgttaggtacttcatagattggaagagtgatggggacagctactttacaatagatggaaatgaaggaaccatcgccactaatgaattactagacagagaaagcactgcgcagtataatttctccataattgcgagtaaagttagtaaccctttattgaccagcaaagtcaatatactgattaatgtcttagatgtaaatgaatttcctccagaaatatctgtgccatatgagacagccgtgtgtgaaaatgccaagccaggacagataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttagccatagttgtactgtatgtagcactgcgaaggcagaagaaaaaagacaccctgatgacctctaaagaagacatcagagacaacgtcatccattacgatgatgaaggaggtggggaggaagatacccaggctttcgacatcggggctctgagaaacccaaaagtgattgaggagaacaaaattcgcagggatataaaaccagactctctctgtttacctcgtcagagaccacccatggaagataacacagacataagggatttcattcatcaaaggctacaggaaaatgatgtggatccaactgccccaccatacgattcactggccacatatgcctacgaagggagtgggtccgtggcagagtccctcagctctatagactctctcaccacagaagccgaccaggactatgactatctgacagactggggaccccgctttaaagtcttggcagacatgtttggcgaagaagagagttataaccctgataaagtcacttaagggagtcgtggaggctaaaatacaaccgagaggggagatttttaaaaaagaaaaagaaacacaaatattaatagaaatctctctcacacacacacacacacacaaacacacacacacacacacacactctgggacaagattcctttgattacctggtttctagtaagttactaaattaatcatattgtcagttttggtttattctgccaacaagagatacatcctataatgtgtacttgctttgttttgttgttttgttttttcacaatcacactgagacaagctcaggcctattcaatacaatttactgacatgacaacctagaacgaagatagctatgtggcatcacggtggaagagtgttagatttttcttaattccactaaagtgcctattgaaactcttatcatttaaagtggtgtacagtacactctgctgtgatggtattgcgggattcagagataaagacataaaacaaagacaccgtctttatgtcaagaagcaatagcgacactctgactctcctcattccttttgagaacaaaagaagaacactttctgatctccaccttcttctaattcaaaaggttttctttttcttttttaaactgtatgctaaaacgtatttgtttatcctatcctttcagaaaattgaaataaatatgaaaatatcaagttcaatatgtaagtcccaaattctagaaacaatgtttgatcttaacattagttcacattaaagctgttcattaaaatgttactttcttttccaaaaaaaaaagaaagaaaaaaaagaaaaaatattcctctttataaagagaggcctcagggctcaaattacacattaaaataaatattggttttgcttaatattgta

SEQ ID NO: 112765 - DNA, 2722 bp, Homo sapiens
  Payload ID: 2067
  Gene Symbol: CDH13
  Gene Name: cadherin 13
  Uniprot ID: P55290
  ENST ID: ENST00000268613
  CDS Start-End: 94-2376
atctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccagggccaaacaacccacctgcactgcatggttcccccagcaagaacatcccagtgagaatggcccacagatgcctgggcgtgacccacctgcagcttcaaccatgcaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggtta

SEQ ID NO: 112766 - DNA, 2195 bp, Homo sapiens
  Payload ID: 2067
  Gene Symbol: CDH13
  Gene Name: cadherin 13
  Uniprot ID: P55290
  ENST ID: ENST00000428848
  CDS Start-End: 124-2148
tttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacag

SEQ ID NO: 112767 - DNA, 831 bp, Homo sapiens
  Payload ID: 2067
  Gene Symbol: CDH13
  Gene Name: cadherin 13
  Uniprot ID: P55290
  ENST ID: ENST00000431540
  CDS Start-End: 124-696
tttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaagagaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccactagcactcggtatttcaaatccattttctctacagaatgatgtgtttaaataaattgtcctgttgactgaa

SEQ ID NO: 112768 - DNA, 2199 bp, Homo sapiens
  Payload ID: 2067
  Gene Symbol: CDH13
  Gene Name: cadherin 13
  ENST ID: ENST00000539548
  CDS Start-End: 124-282
tttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaactgatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttac

SEQ ID NO: 112769 - DNA, 3684 bp, Homo sapiens
  Payload ID: 2067
  Gene Symbol: CDH13
  Gene Name: cadherin 13
  ENST ID: ENST00000566620
  CDS Start-End: 1-2106
ttttctcaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagt

SEQ ID NO: 112770 - DNA, 545 bp, Homo sapiens
  Payload ID: 2067
  Gene Symbol: CDH13
  Gene Name: cadherin 13
  ENST ID: ENST00000562601
  CDS Start-End: 126-329
tatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccagacaccagtgaggcctaccatatacctatgtcaaaacctgcaatttatcaaaaataaagcccgagatagtaacagtcttgctgaccacaaaggcaaaaggatccaggtaaacagattgcttccaggactattatttcatgatgagctttcaggtatatagcacatgagagggaggacaaggtgcggctgcacttcaagagaccacgttggacaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcg

SEQ ID NO: 112771 - DNA, 1456 bp, Homo sapiens
  Payload ID: 2067
  Gene Symbol: CDH13
  Gene Name: cadherin 13
  ENST ID: ENST00000567445
  CDS Start-End: 55-258
agtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctatgtggctgacaag

SEQ ID NO: 112772 - DNA, 810 bp, Homo sapiens
  Payload ID: 2067
  Gene Symbol: CDH13
  Gene Name: cadherin 13
  Uniprot ID: P55290
  ENST ID: ENST00000565636
  CDS Start-End: 124-651
tttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaagatgaagatttggcaagttctgtgcctagcacgatggctgacatgagataaaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccacta

SEQ ID NO: 112773 - DNA, 589 bp, Homo sapiens
  Payload ID: 2067
  Gene Symbol: CDH13
  Gene Name: cadherin 13
  ENST ID: ENST00000568770
  CDS Start-End: 125-238
atttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccagtcaggtggtcctgtgtgcaagtcccagttccaggcccttccactggctgtccaatggcttggagtctgaggctcagttttcccacttgcagaaggaaggaatgatgccaacttcgtgctgctgctaacatctgcagaagatttggactgcactcctggatttcagcagaaagtgttccatatcaatcagccagctgaattcattgaggaccagtcaattctaaactatggtaggaaatctatgccttttggattttcatccccaagaaccaccttcaaaagaaagaaatggaaaagcataaaatcaagtgaccttcagtgactgtaagggaaacgacaagctacgctatgaggtctcgagcccatacttcaaggtgaacagcgatggcggcttagttgctctgagaaacataactgcagt

SEQ ID NO: 112774 - DNA, 583 bp, Homo sapiens
  Payload ID: 2067
  Gene Symbol: CDH13
  Gene Name: cadherin 13
  ENST ID: ENST00000569144
  CDS Start-End: 128-298
tctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaactatgtattctactagctgacagacttttaaagtagaggccacttttaaaagcctgggctcccatgagaaggaaatctgcagtagacaaagcaagatgcttagttaacagcagcaacccagtgcctgtaattttcaagtccttggaggcacaccatgtcacccaagtgaccttcagtgactgtaagggaaacgacaagctacgctatgaggtctcgagcccatacttcaaggtgaacagcgatggcggcttagttgctctgagaaacataactgcagtgggcaaaactctgttcgtccatg

SEQ ID NO: 112775 - DNA, 8042 bp, Homo sapiens
  Payload ID: 2067
  Gene Symbol: CDH13
  Gene Name: cadherin 13
  Uniprot ID: P55290
  ENST ID: ENST00000567109
  CDS Start-End: 291-2432
aagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagtaactgttctctgatttctatcttgtgtccaatgtcactgatgttgggtcttgtcttagtgcaagttcacatttttgacagaccatttggggtccgtcgtacatctctggttggtgagtgagtctatgaagacagaagtaccagttctcagcatgggccatggactcatcttgtccacctcatgatatgatctgagggtgtcataatcagctataaaggtaattgcatactcaaagatgagacggaccattctcagttgatgaccacattaagcatagtcatggccatctgtcaacagtcccaagacctggggatttttctctggaacaaatcctgttgctggatcaggagatgccacaccttgaacttgatagggtcattctccacgagcacatgcccccgactcagggacaggggaatctaagcctgtgcattcacactccacaagatttcctctactggctttacagggcactgtcacgcgtctcccgggcgcaccttgctcccctcttcctgcaaggcagggggagaacgttcatccttgaacaaacaaagagcatcctcagccagtcaggcggctggtagccggacacatatgctaactggcaatcaggaagtcaccctccaatgtaaacttcagccacatgcagggagaaacacagcagctgagtggccattcactcaaggaaacaaatacagcatgactccttttctctcaagctggtaggctctcctgcactttgtgaaccgaaccagaagattaacttcgctgaaaattcagaaaaataggagtaaagtgcacacttcattaataaatagaatatgcctcaactttcccttatttaaacatattctctgtccccacagttctaatcaggacagagatacttctgtcatgttgttcctcctaatagtttccagaaaaaaaggaaaataaaccaattcttataggccaaagtggtagcatttcctgaatcataagatgttttgttcatttgctggaatatattacattgtttactgaaaaccatagtagaatcaaaatgttatttcattattacctatgcattttatctgagtccaacttattaaaaaacgaagtcaagtaaggaccagaaattgcttttcccaattactgagcacaggtctgagggttttatttccactgagcaaatagtcacaccttcacttctttttattaatactcaaccaacttagttgattaaaaatcacattttctccctcattttacatacgataaattaattattttggataatttgttttaataagaatatgcacacattttctaatttcaataaaagtcaccttcaataccgccagttctctccaaatgagcatcattccaggcagatatacctgctgtgcctcttggccgacaccagcaaatctaagcattataacgaaataaatccagccagatttcatggtaggtatcaaataagactttggctcttaaagaacatcgttagaaattttgatagctcattccagagtttcagaatgtcatttaaaacagtctgataaatggaacaaccatctaccatcacactcatagagtagctcaaattgcattttacccaaataaatacactgggtcttaatcttaagatgtgacaactaaaaaatttttaacaagtctgtgtttgatcctggatttagtgcagttgcacccaggcacgagctctccagatgattctgaggaaaggagtctacaattttcctagggggtgtatgaacatggtaccaaaaaggtgattaataattataataatggtttatatttatcaactgcttattatgtgcccacactgtacaaaatccttacagatagtaactcattaatccctccagtaacatatgagacaagcactactatcttctccaactcacagataaagaaggctgaggctcagaaaaattgaatggcttgcccaaggtaagtggcctccagaaccaaacctcaggctatctggctccagggttcatgttcttccgacaacatcacaatgccactctcaacccaggagcaaaaccagacaaagtgcctactgcagaccggaagaccctcgtttgaagcctccattagcgtgactatgcagctagaccaacttactgttaagcaacagtaccttttactatgaggtaccctttactattaagtaccttttactaacagtatcttctgttacctattattaagttcatgctatacttcttcaatctgaaagctttctgttaaaaaaaaaaatgttaacatcgttctaaattaatattgagaccttagaaatttttcctgtgcaagataacgtaattatttgccccttcccttccatggcttgttagcaggtagatgaggggcttctcctagattaatttaacatctcagttaatcaaaagtagccgggcatggtgactcatgcctgtaatcccagccctttgggaggcagaggcgggtggatcacttaaggtcaggagttcaagaccagcctggccagcatggtgaaaccctatctctactaaaaaatacaaaaattagctgggtgtggtggtgcacacctgaaaccccagctactcaggaggctgaggcaggagaatcgcttgaacccaggaggcagagtttgcagtgagccattgcactccagcctgggcaacagagcaagactccgtcaaaaaaaaaaaaaaaaaaaaagaaagaaaaggaaatttatgaactccagagtacccattcactaccaaaccaactgaggggagagaaaactgagggagaaagtggggtggggtctcaaagggtttgcactgtgctttgctataaatcattcaaaggggcaaattctaaaggatctctaagtagttgctgattttgtaaaggtagcccataaatctgtttacgtgtagctgccttaaacatgagtcaacagggtaagtcacaccaacaggaaacccaagcactaaaaaagccacctaccttttctgtttaccaaatactaagaataataatctaataatctggctacatctttcataaagacctccatcttctctccttaactgactgttgagatttgataattttcacagtctaatgataaaatgctttcaaaatggttcatctaacacaattaacaattcttttactatatgcaatgtgttacccttactatatttcctattgctaatagattagcccactattgaaaaaattctgcagttgtgaccgtgttcacatgaaagcatatacaagacatggagagacagcaaaaaatggtgggaatgggtgtgtgtatgagggtttcagataagaacttcaattatataatttaagaagagtcagtctataatttaagcagaaataattgagatactcatcaaattaagtaagcggaaaaatttcctctctctcatactatgttgctatcatcacatctatcgttggagggttgctgagcttgatacgcctttgaaccattttatttgactttccacgtgccgtctcattggtagggagatggtgaaaagcgttgggtggtgtaggacgagggaggttttcactctgaagctatgaagatttggagaaaggggcttatagaagcactatgaaaataaactggagactatttttttgctactttttaaaaagctttttctttagagagtactaaagccattctatatctgtcgtacacatgaattcagactattattagagagttatatctgtgttgtcatgcacatgtcaacactgtcctgatgacaaaattttatgtatccccccagataaaaattttaagaaattttaaatgctttttattcacacacacttttcaaaagggataaaagttaatcatgttaaaatattcagtctatggcagatgtcgctcctttgggccctcactgctgaattgcttacagtttctgagctgtaaactaacatttgctttactatgtagttacagagaaatgtgcaacttgtttgtgaaacattcaaataaagcttatctgggatttttaa

SEQ ID NO: 112776 - DNA, 2640 bp, Homo sapiens
  Payload ID: 2067
  Gene Symbol: CDH13
  Gene Name: cadherin 13
  ENST ID: ENST00000615627
  CDS Start-End: 1-1062
cccacattctgcaggagagaatttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagt

SEQ ID NO: 112777 - DNA, 3564 bp, Homo sapiens
  Payload ID: 2067
  Gene Symbol: CDH13
  Gene Name: cadherin 13
  ENST ID: ENST00000622885
  CDS Start-End: 1-1986
tctcaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagt

SEQ ID NO: 112778 - DNA, 2847 bp, Homo sapiens
  Payload ID: 2068
  Gene Symbol: CDH15
  Gene Name: cadherin 15, type 1, M-cadherin (myotubule)
  Uniprot ID: P55291
  ENST ID: ENST00000289746
  CDS Start-End: 66-2510
actcagcctggacgcgcttcttcgggtcgcgggtgcactccggcccggctcccgcctcggccccgatggacgccgcgttcctcctcgtcctcgggctgttggcccagagcctctgcctgtctttgggggttcctggatggaggaggcccaccaccctgtacccctggcgccgggcgcctgccctgagccgcgtgcggagggcctgggtcatccccccgatcagcgtatccgagaaccacaagcgtctcccctaccccctggttcagatcaagtcggacaagcagcagctgggcagcgtcatctacagcatccagggacccggcgtggatgaggagccccggggcgtcttctctatcgacaagttcacagggaaggtcttcctcaatgccatgctggaccgcgagaagactgatcgcttcaggctaagagcgtttgccctggacctgggaggatccaccctggaggaccccacggacctggagattgtagttgtggatcagaatgacaaccggccagccttcctgcaggaggcgttcactggccgcgtgctggagggtgcagtcccaggcacctatgtgaccagggcagaggccacagatgccgacgaccccgagacggacaacgcagcgctgcggttctccatcctgcagcagggcagccccgagctcttcagcatcgacgagctcacaggagagatccgcacagtgcaagtggggctggaccgcgaggtggtcgcggtgtacaatctgaccctgcaggtggcggacatgtctggagacggcctcacagccactgcctcagccatcatcacccttgatgacatcaatgacaatgcccccgagttcaccagggatgagttcttcatggaggccatagaggccgtcagcggagtggatgtgggacgcctggaagtggaggacagggacctgccaggctccccaaactgggtggccaggttcaccatcctggaaggcgaccccgatgggcagttcaccatccgcacggaccccaagaccaacgagggtgttctgtccattgtgaaggccctggactatgagagctgtgaacactacgaactcaaagtgtcggtgcagaatgaggccccgctgcaggcggctgcccttagggctgagcggggccaggccaaggtccgcgtgcatgtgcaggacaccaacgagccccccgtgttccaggagaacccacttcggaccagcctagcagagggggcacccccaggcactctggtggccaccttctctgcccgggaccctgacacagagcagctgcagaggctcagctactccaaggactacgacccggaagactggctgcaagtggacgcagccactggccggatccagacccagcacgtgctcagcccggcgtcccccttcctcaagggcggctggtacagagccatcgtcctggcccaggatgacgcctcccagccccgcaccgccaccggcaccctgtccatcgagatcctggaggtgaacgaccatgcacctgtgctggccccgccgccgccgggcagcctgtgcagcgagccacaccaaggcccaggcctcctcctgggcgccacggatgaggacctgcccccccacggggcccccttccacttccagctgagccccaggctcccagagctcggccggaactggagcctcagccaggtcaacgtgagccacgcgcgcctgcggccgcgacaccaggtccccgaaggcctgcaccgcctcagcctgctgctccgggactcggggcagccgccccagcagcgcgagcagcctctgaacgtgaccgtgtgccgctgcggcaaggacggcgtctgcctgccgggggccgcagcgctgctggcggggggcacaggcctcagcctgggcgcactggtcatcgtgctggccagcgccctcctgctgctggtgctggtcctgctcgtggcactccgggcgcggttctggaagcagtctcggggcaaggggctgctgcacggcccccaggacgaccttcgagacaatgtcctcaactacgatgagcaaggaggcggggaggaggaccaggacgcctacgacatcagccagctgcgtcacccgacagcgctgagcctgcctctgggaccgccgccacttcgcagagatgccccgcagggccgcctgcacccccagccaccccgagtgctgcccaccagccccctggacatcgccgacttcatcaatgatggcttggaggctgcagatagtgaccccagtgtgccgccttacgacacagccctcatctatgactacgagggtgacggctcggtggcggggacgctgagctccatcctgtccagccagggcgatgaggaccaggactacgactacctcagagactgggggccccgcttcgcccggctggcagacatgtatgggcacccgtgcgggttggagtacggggccagatgggaccaccaggccagggagggtctttctcctggggcactgctacccagacacagaggccggacagcctgaccctggggcgcaactggacatgccactccccggcctcgtggcagtgatggcccctgcagaggcagcctgaggtcaccgggcccgacccccctgggcctggggcagcctccttcctgtaggcgagggcccaagtctgggggcagaacctgagtgtggatggggcggccaggaagaggccccttcctgccggggtgggaagagtttctctccatcggccccatgcgggtcacctccctagtcccacctttgcctcctaccagtgaacctcatctttgtatgaaagacagcaacctcctgggtaaatctgaatgaaaaacgtgctagtctctttcatgca

SEQ ID NO: 112779 - DNA, 2954 bp, Homo sapiens
  Payload ID: 2069
  Gene Symbol: CDH16
  Gene Name: cadherin 16, KSP-cadherin
  Uniprot ID: O75309
  ENST ID: ENST00000299752
  CDS Start-End: 195-2684
aggcctgctgctgtgggcccagtggccttttccactcctgagcaagcgtggctgaaccctcctacctgctcaagtgccctgccttgccccacccagcccagcctggccagagccccctggagaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggta

SEQ ID NO: 112780 - DNA, 2821 bp, Homo sapiens
  Payload ID: 2069
  Gene Symbol: CDH16
  Gene Name: cadherin 16, KSP-cadherin
  Uniprot ID: O75309
  ENST ID: ENST00000394055
  CDS Start-End: 128-2551
gctcaagtgccctgccttgccccacccagcccagcctggccagagccccctggagaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggta

SEQ ID NO: 112781 - DNA, 2694 bp, Homo sapiens
  Payload ID: 2069
  Gene Symbol: CDH16
  Gene Name: cadherin 16, KSP-cadherin
  Uniprot ID: O75309
  ENST ID: ENST00000565796
  CDS Start-End: 59-2431
ttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatggg

SEQ ID NO: 112782 - DNA, 2526 bp, Homo sapiens
  Payload ID: 2069
  Gene Symbol: CDH16
  Gene Name: cadherin 16, KSP-cadherin
  Uniprot ID: O75309
  ENST ID: ENST00000568632
  CDS Start-End: 59-2257
ttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggt

SEQ ID NO: 112783 - DNA, 3539 bp, Homo sapiens
  Payload ID: 2069
  Gene Symbol: CDH16
  Gene Name: cadherin 16, KSP-cadherin
  ENST ID: ENST00000567269
  CDS Start-End: 95-622
gcctggccagagccccctggagaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctgtttgccctcccaccgtgaaccaggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacaggtatggccaggcagtgatgggagcccctgggagggggtacaaacctcagacagacagacagcaggactgagcttcctcccagaggccctcactggcaacccccagccccaagcaggagaggcagatatgaagctgggttcaatgttcctctctgagaatggatctactcctccggtgggcaagtctggcatctgcctcccctctctgatcattctcctagattgacacacaaaatctcccagccctgtcctttagccactggagggcctctcagggtgtcagcttcagggactggtatagggccggggaggtggcaggaggaccaggggctgcccctggggaaggagtgctggagtgaatgggccactggagccaggtgtggaggacactgaacactgctcaggacagagagctggccctggggtggggagccccgggaggcaggtttcaactctgagctgggctgtgatacagggcagacccagcagcagtgagctccgccaaagtcagggatgtccacagtggcatggggatgatgacaggtggagagaagcatggagggagcatggcaggggagtctataaggcgaggctcatgggctgcgggagcagcccagggacctcagagctcaccctccccctggcaacacctggccagctcagcactgcctcctctgcagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatggg

SEQ ID NO: 112784 - DNA, 2604 bp, Homo sapiens
  Payload ID: 2069
  Gene Symbol: CDH16
  Gene Name: cadherin 16, KSP-cadherin
  ENST ID: ENST00000570262
  CDS Start-End: 87-2336
agagccccctggagaaggagctctcttcttgcttggcagctggaccaagggagccagtcttgggcgctggagggcctgtcctgaccatggtccctgcctggctgtggctgctttgtgtctccgtcccccaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattgg

SEQ ID NO: 112785 - DNA, 2026 bp, Homo sapiens
  Payload ID: 2069
  Gene Symbol: CDH16
  Gene Name: cadherin 16, KSP-cadherin
  ENST ID: ENST00000568698
  CDS Start-End: 63-809
cttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggcccta

SEQ ID NO: 112786 - DNA, 715 bp, Homo sapiens
  Payload ID: 2069
  Gene Symbol: CDH16
  Gene Name: cadherin 16, KSP-cadherin
  ENST ID: ENST00000567009
  CDS Start-End: 1-715
atcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccagtacctgctccaggtgcgggctcagaattcccatggcgaggactatgcggcccctctggagctgcacgtgctggtgatggatgagaatgacaacgtgc

SEQ ID NO: 112787 - DNA, 582 bp, Homo sapiens
  Payload ID: 2069
  Gene Symbol: CDH16
  Gene Name: cadherin 16, KSP-cadherin
  ENST ID: ENST00000565235
  CDS Start-End: 210-582
tgcttggcagctggaccaagggagccagtcttgggcgctggagggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaagg

SEQ ID NO: 112788 - DNA, 3693 bp, Homo sapiens
  Payload ID: 2070
  Gene Symbol: CDH17
  Gene Name: cadherin 17, LI cadherin (liver-intestine)
  Uniprot ID: Q12864
  ENST ID: ENST00000027335
  CDS Start-End: 126-2624
ggaagagggagtgttcccgggggagatactccagtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccataaaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagagtttgaggagagggagtatgtcgtcttgatccgcatcaatgatgggggtcggccacccttggaaggcattgtttctttaccagttacattctgcagttgtgtggaaggaagttgtttccggccagcaggtcaccagactgggatacccactgtgggcatggcagttggtatactgctgaccacccttctggtgattggtataattttagcagttgtgtttatccgcataaagaaggataaaggcaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcacccaccaccatgcccagctaatttttgtatttttaatagagacggggtttcgccatttggccaggctggtcttgaactcctgacgtcaagtgatctgcctgccttggtctcccaatacaggcatgaaccactgcacccacctacttagatatttcatgtgctatagacattagagagatttttcatttttccatgacatttttcctctctgcaaatggcttagctacttgtgtttttcccttttggggcaagacagactcattaaatattctgtacattttttctttatcaaggagatatatcagtgttgtctcatagaactgcctggattccatttatgttttttctgattccatcctgtgtccccttcatccttgactcctttggtatttcactgaatttcaaacatttgtcagagaagaaaaacgtgaggactcaggaaaaataaataaataaaagaacagccttttcccttagtattaacagaaatgtttctgtgtcattaaccatctttaatcaatgtgacatgttgctctttggctgaaattcttcaacttggaaatgacacagacccacagaaggtgttcaaacacaacctactctgcaaaccttggtaaaggaaccagtcagctggccagatttcctcactacctgccatgcatacatgctgcgcatgttttcttcattcgtatgttagtaaagttttggttattatatatttaacatgtggaagaaaacaagacatgaaaagagtggtgacaaatcaagaataaacactggttgtagtcagtttt

SEQ ID NO: 112789 - DNA, 2204 bp, Homo sapiens
  Payload ID: 2070
  Gene Symbol: CDH17
  Gene Name: cadherin 17, LI cadherin (liver-intestine)
  ENST ID: ENST00000441892
  CDS Start-End: 94-1836
agtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccataaaagtgaaggacatcaacgacaatcgacccacgtttctccagtcaaagtacgaaggctcagtaaggcagaactctcgcccaggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagagtttgaggagagggagtatgtcgtcttgatccgcatcaatgatgggggtcggccacccttggaaggcattgtttctttaccaggtataattttagcagttgtgtttatccgcataaagaaggataaaggcaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcacccaccaccatgcccagctaatttttgtatttttaatagagacggggtttcgccatttggccaggctggtcttgaactcctgacgtcaagtga

SEQ ID NO: 112790 - DNA, 2625 bp, Homo sapiens
  Payload ID: 2070
  Gene Symbol: CDH17
  Gene Name: cadherin 17, LI cadherin (liver-intestine)
  Uniprot ID: Q12864
  ENST ID: ENST00000450165
  CDS Start-End: 127-2625
aatcacggtggaagtatgatattttggctgtggatctgagttgatcaatctgcttagtggacttgagtccccccacccccgcttgtctgattggggctcctgggaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccataaaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagagtttgaggagagggagtatgtcgtcttgatccgcatcaatgatgggggtcggccacccttggaaggcattgtttctttaccagttacattctgcagttgtgtggaaggaagttgtttccggccagcaggtcaccagactgggatacccactgtgggcatggcagttggtatactgctgaccacccttctggtgattggtataattttagcagttgtgtttatccgcataaagaaggataaaggcaaagataatgttgaaagtgctcaagcatctgaagtcaaacctctgagaagctga

SEQ ID NO: 112791 - DNA, 637 bp, Homo sapiens
  Payload ID: 2070
  Gene Symbol: CDH17
  Gene Name: cadherin 17, LI cadherin (liver-intestine)
  ENST ID: ENST00000521491
  CDS Start-End: 196-637
agtcgtagcaagagtctcgaccactgaatggaagaaaaggacttttaaccaccattttgtgacttacagaaagggtctcgctctgtcacccaggctgcagtgcagtggcgcaatcatggctggctgcaacctctgcctcctgggctcaagtgatcctcccacctcagcctcccaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccataaaagtgaaggacatcaacgacaatcgacccacgtttctccagtcaaagtacgaaggctcagtaaggcagaactctcgcccaggaaagcccttcttgtatg

SEQ ID NO: 112792 - DNA, 565 bp, Homo sapiens
  Payload ID: 2070
  Gene Symbol: CDH17
  Gene Name: cadherin 17, LI cadherin (liver-intestine)
  ENST ID: ENST00000520952
  CDS Start-End: 1-271
tattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcag

SEQ ID NO: 112793 - DNA, 2809 bp, Homo sapiens
  Payload ID: 2071
  Gene Symbol: CDH18
  Gene Name: cadherin 18, type 2
  Uniprot ID: Q13634
  ENST ID: ENST00000274170
  CDS Start-End: 259-2631
aggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagt

SEQ ID NO: 112794 - DNA, 3087 bp, Homo sapiens
  Payload ID: 2071
  Gene Symbol: CDH18
  Gene Name: cadherin 18, type 2
  Uniprot ID: Q13634
  ENST ID: ENST00000382275
  CDS Start-End: 521-2893
ggagcccagggctcgaggtgcgcggagcctgagtctgggctttccgaggacggcgagcagctgtgcccagagctctgggaaagtcccctctctttgcttcttataaattaagttcctttccaccagttagggcaagtccgccaagatagactgaagaggagcaagaacagaaacagggagccagttacagatctatcccaagaattctggggagagatgatggtgtctgcagcagagtgacagcagtggagattgagagaaaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagtaaaaaaaaaaaaaaaa

SEQ ID NO: 112795 - DNA, 2386 bp, Homo sapiens
  Payload ID: 2071
  Gene Symbol: CDH18
  Gene Name: cadherin 18, type 2
  Uniprot ID: Q13634
  ENST ID: ENST00000502796
  CDS Start-End: 476-2200
gaggacggcgagcagctgtgcccagagctctgggaaagtcccctctctttgcttcttataaattaagttcctttccaccagttagggcaagtccgccaagatagactgaagaggagcaagaacagaaacagggagccagttacagatctatcccaagaattctggggagagatgatggtgtctgcagcagagtgacagcagtggagattgagagaaaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatca

SEQ ID NO: 112796 - DNA, 2432 bp, Homo sapiens
  Payload ID: 2071
  Gene Symbol: CDH18
  Gene Name: cadherin 18, type 2
  ENST ID: ENST00000506372
  CDS Start-End: 513-2240
tttaagtactgcagtcatctaatgtacttcaccagcagaatctaaattctagatccaagaaagattattgtcagctggctttattcagggtccaattctgagcccagtatcaagtaataaagattgagtggtgtgataattagagatgcttcaaccaaagttttcaaaaatgggaacatattgaacccttggttctacaactaccttcttacaacgaagttagtatgcagtgctctccaagtcaataaggaaagtggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagcct

SEQ ID NO: 112797 - DNA, 3542 bp, Homo sapiens
  Payload ID: 2071
  Gene Symbol: CDH18
  Gene Name: cadherin 18, type 2
  Uniprot ID: Q13634
  ENST ID: ENST00000507958
  CDS Start-End: 992-3364
tagattgattatacagcagcagcatgagctgagtctcagagctgagcgagcgtcagggtgaaaaggaaagagagaaagagagagagagagaaaaaaaagcggggagagagagagagagaggaacacaaggtggggaggaagccagtgcacgttccatagcatcactactgtgactgcttgtacccgataatcttgctctgcagctccctcagtgaacaacttactgaggtgcctttctttttacaagaggatgtcagctctgagctccagcaagaaataacagacttcaccttggaatagctcatcttactcctgcatcattaaagcggattttcaaaagaaaacaaaaatcaagtcccctttccagttccactttcttccagcattgaacaggaacagtttcacgctccaggactcaaccacagcaatatgtaagaagaacacacaccaaacattcctgaagtgatttaaaagatggaatctcgctctgtctcccaggctggagtgcagtggcgcaatctcagctcattgcaacctccacctcctgggttcacgccattctcctgcctcagcctcctgagtagctgggactacaggcgcccgccaccacgccaggatagactgaagaggagcaagaacagaaacagggagccagttacagatctatcccaagaattctggggagagatgatggtgtctgcagcagagtgacagcagtggagattgagagaaaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagt

SEQ ID NO: 112798 - DNA, 2318 bp, Homo sapiens
  Payload ID: 2071
  Gene Symbol: CDH18
  Gene Name: cadherin 18, type 2
  ENST ID: ENST00000511273
  CDS Start-End: 379-2151
ggagcctgagtctgggctttccgaggacggcgagcagctgtgcccagagctctgggaaagtcccctctctttgcttcttataaattaagttcctttccaccagttagggcaagtccgccaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaaggtgaacatatatacacatatttgtttatctatgtggtatctgctttgaccttatatgtaataggctttattcttatatacacacaaacatcttgcaaatcagcattcaaagtcagtttgatgctactgtgttatgatctgtgaatagcttgtgtttaaaattgagccatatgtacaaataactttcattgaatttattcagaagcatctctttaaacaagaaatgtacatgtaatatgctcttgggcaaattttaagagaaatcttagctgacaaacttgtttatgagagctgctgccactgcttggagg

SEQ ID NO: 112799 - DNA, 1476 bp, Homo sapiens
  Payload ID: 2071
  Gene Symbol: CDH18
  Gene Name: cadherin 18, type 2
  ENST ID: ENST00000515257
  CDS Start-End: 1-1326
tgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaag

SEQ ID NO: 112800 - DNA, 6341 bp, Homo sapiens
  Payload ID: 2072
  Gene Symbol: CDH19
  Gene Name: cadherin 19, type 2
  Uniprot ID: Q9H159
  ENST ID: ENST00000262150
  CDS Start-End: 294-2612
tgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattagggctttttaccatcaaaatttttaaaagtgctaatgtgtattcgaacccaatggtagtcttaaagagttttgtgccctggctctatggcggggaaagccctagtctatggagttttctgatttccctggagtaaatactccatggttattttaagctacctacatgctgtcattgaacagagatgtggggagaaatgtaaacaatcagctcacaggcatcaatacaaccagatttgaagtaaaataatttaggaagatattaaaagtagatgagaggacacaagatgtagtcgatccttatgcgattatatcattatttacttaggaaagagtaaaaataccaaacgagaaaatttaaaggagcaaaaatttgcaagtcaaatagaaatgtacaaatcgagataacatttacatttctatcatattgacatgaaaattgaaaatgtatagtcagagaaattttcatgaattattccatgaagtattgtttcctttatttaaaaaaaaaaaaaaaaaaaaagaatgctaggtaatcttcgtagaaaactagaaagtatgataaacaacagttggaggaatccatggaaaatagacgagaaaatgtaaataaggctttctggggatcacagaacttttgtatgaataaaagccttataaaaccagctctggcatatgactaaaatattcctctactatttttcaatgtcatctaatgcaaacgctcaacctttttaaatggttaatgtgagaaaggcactgaattaagatatcttagtgttattttatttactcaattttcatctttcacactgtaagaataaaatgtttttgtggttaagttcctgatactatatagagataaactttaaaactttaacacctaggataatgtgggtgattacataaatgtttaaaaacatttaccttatatggaaagcagatttctgactaagatgccatgattcattctagtttgatattttaaaactttgccaagagcactctttaaaactgatttcaaatttgaacagatacttggtgtatacaaattaatcagagttatatagtataaatttgtattatttttgatattacaactttgtattaaaaaggaaaatatatttaggtgtttgtcatagattttttttcatatgcaactcaaaacacattcttatgtcaaaatacaatagcaaaatacaagtcaatatttactcataattaaatgcaaactttatgaaactggtggaaagtgtggaaaaatttaagtaaatttttacctctactaaaaattatttagacaacttaaaggaatactggattcaaacttcagttactattcactgtaaatattatgatcaactgaactgacttaccattcatgggataaaacatgatacaattctcagtatttgcttttctgttaagagcttggaatatgactgatgcttcagtgtcatttttttattattgaatataaaattaggtgcaatagatacatttattgtagccttaagaaggaaatcaatgctaagctgttgggcataaaactttacagtaacattagataacaagataataaaacactttaattttaatcgaccttttaagaatgatctttattattctatccaaatcaaggtagacttcaaaatttatggtttgaacaggaagaaagtagtgaatacaaaattcttaaaattggttcatatgatcatttttttattaatagcatgtgagactaagctgaaccaaactggccatatatgttaaatcaaataatttgagtaattttgaaatattgatgaagtagttaaatggttataatatattttattggtactttgaaatttaaacatctatatcacataataaagaaagtttttcatcaatctgaaacaggcaccattaaattggtgacacaaatattatcatttcacaaaagcttgagaaaaccagatttgaagtgaaataatttaggaagatattaaaagtggatgagaggacataagatgtagtcaatccttaacgcaatgataccattattaggaaagaggaaaaataccaaacaagagaaaatttaaaggagcaaaaatttgcaagtcaaatagaaatgcacaaatcgagagaacatttacatttctatcacattgacatgaaaattgaaaatgtatagtcagagaaattttcatgaattattccatgaagtgttgtttcctttatttaaaaagaatgctaggtaatcttagtagaaaactaaaaagtatgataaacaacagatggaagaattcatggaaaatagacgagaaaaagtaaataaggctttctggagatgacggaaattttgtatgaataaaagccttataaacaatgaatacatttggataaacaactcattaaaatgcacattaatggaatacctgtacaaatagttttaatacttgtgtccagtggcactaaagagatatattaaaatagattctggttgagttgattataagattgtcaatcataggatacacagggaaagcacagacacgattgctcatctctttggtagtctaaaatatgttccttttaaccacatcaaaagatactatctgattctaatacagaaggtgcaacttcctaggaattatactttgtattatattcaataattattttatgttttgcatcacatgggtgttgcaagaacacagctcttaaactaaaaaggcattacattaagaatttatttttgtaaattttaataaactctaaattaatgcaaaatatttatgaaaatagcacagcttcacattaatacccacagtacttaaatatctcccttagttgactcacagctttgtatgtaagcttcaaatttttaatggtaaaaataagaaaattaggactagcgaactgctagttgttccctcagtgcatgtgcttgagcctaacagatctttgtttgaattagttactttcaattaagcgaacatataatatttgttaaactgcttaatctttccagatctcactttgtaaaatgacgtccaatcaacctatttcacatggttgttatgaagaattaataataagatatgtaaaaccagcagcaccaatagtgcctgacaaaatataactgctcaataaataacagtgaattattataacaacagctaatggtattctattggaacacatggtctgtttcttttccaattctgagtgatctcaacagcctcacggcacattgaaaataaaagtcaacttcctcaccttccccataggccatggactttcccatctctacccacttgtgcagtttctcctctttcctctctcctcctcagttactaaagcaatcttccttcaaacacttctattttccattacatcacttcattcaggttggtgatcagctgcaacttcctcagaaagaccactgctgcttccagtgaccctggctttgtcttgctttgtattagattactcagctccctggtattattgttgtctttatcgcttattagaatgtaacccttaatgggcaagaaattgtcagtcttgttcatttatcatcgtataaaaaatgtttctagcacacagaaagtgaccaataaatatttctggaattaatgtagtaatgaatccaatctattttacttagtgacttgtagaaattcttttggtttccattgactatttttatagaatattaatatggaattaaagtatttttcaaaa

SEQ ID NO: 112801 - DNA, 1677 bp, Homo sapiens
  Payload ID: 2072
  Gene Symbol: CDH19
  Gene Name: cadherin 19, type 2
  ENST ID: ENST00000454642
  CDS Start-End: 1-1305
ggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatgatatagggatgctgtattccttgaagattacatttcaaagagatggtcaccattacttgataaatacaatcctggatcctaaagcttccaagaaacttgttgaacttttgaaagatttccatacgcttcaaagggacaaagaaaaaacttacatacaaagctttttttttccctctctctctctctttctctgtgtgtgtgtgtgtgtgtgtgtgtgtgtgtatgaatgctctgagaaaaggaaggaaagaaaaaatattttcccttgctttcaacaagtacaaggcctctaatttttaatttgttttgttctttcaaattatcattgcaaatagtacatatattttaaataaaaacactaaaacaaactaaa

SEQ ID NO: 112802 - DNA, 1963 bp, Homo sapiens
  Payload ID: 2072
  Gene Symbol: CDH19
  Gene Name: cadherin 19, type 2
  Uniprot ID: Q9H159
  ENST ID: ENST00000540086
  CDS Start-End: 248-1720
aatggggcacatcgagagtttgctgagaagactgtgaagcaaaaagaagaaagtttttcctactcttccttatgtgtccaacacgaagtttgctgttcagttttcacagaacttctagaagttgaagttacaaaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcagggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattca

SEQ ID NO: 112803 - DNA, 2588 bp, Homo sapiens
  Payload ID: 2072
  Gene Symbol: CDH19
  Gene Name: cadherin 19, type 2
  ENST ID: ENST00000579658
  CDS Start-End: 298-1923
atactgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattag

SEQ ID NO: 112804 - DNA, 587 bp, Homo sapiens
  Payload ID: 2072
  Gene Symbol: CDH19
  Gene Name: cadherin 19, type 2
  ENST ID: ENST00000580157
  CDS Start-End: 393-587
aatggggcacatcgagagtttgctgagaagactgtgaagcaaaaagaagaaagtttttcctactcttccttatgtgtccaacacgaagtttgctgttcagttttcacagaacttctagaagttgaagttacaaaggacttccacagctatattaaataggagtggtgagagtcagcatccttgtcttgttccagttctcaagggaaatgtttccagcgcttgcccattcagtatcatgtttgctgtgaatttgtcatagatggctcttattatatttcaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccag

SEQ ID NO: 112805 - DNA, 4332 bp, Homo sapiens
  Payload ID: 2073
  Gene Symbol: CDH2
  Gene Name: cadherin 2, type 1, N-cadherin (neuronal)
  Uniprot ID: P19022
  ENST ID: ENST00000269141
  CDS Start-End: 425-3145
cctccaccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctatttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccccctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgtgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgtttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaagcttttaaactggagagacttctgacaacagctttgcctctgtattgtgtaccagaatataaatgatacacctctgaccccagcgttctgaataaaatgctaattttggatctgg

SEQ ID NO: 112806 - DNA, 3737 bp, Homo sapiens
  Payload ID: 2073
  Gene Symbol: CDH2
  Gene Name: cadherin 2, type 1, N-cadherin (neuronal)
  Uniprot ID: P19022
  ENST ID: ENST00000399380
  CDS Start-End: 38-2665
aagcagaaggaattatgggaaatggaaacttgatggcatgtttttattaaggcgttatgtgtgtatcttcactgagaaattaaagaaccaagcagaattgtatgttttcctttcagtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccccctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgtgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgtttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaa

SEQ ID NO: 112807 - DNA, 740 bp, Homo sapiens
  Payload ID: 2073
  Gene Symbol: CDH2
  Gene Name: cadherin 2, type 1, N-cadherin (neuronal)
  ENST ID: ENST00000418492
  CDS Start-End: 168-740
agtaagagtgttccactcagataggctagcatgagcaaggcagaagcctgaaacagttggatgtgttccagaaactgtaagcaattgaatacaatggaaatgaagttcatttacaagaccatgatgagagaattgacttttaggctgtggccacattgttgaaggacatgtgtaacactcaaaggatgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatatt

SEQ ID NO: 112808 - DNA, 610 bp, Homo sapiens
  Payload ID: 2073
  Gene Symbol: CDH2
  Gene Name: cadherin 2, type 1, N-cadherin (neuronal)
  ENST ID: ENST00000430882
  CDS Start-End: 251-610
aagaaacacaaatacacattgattccttgtagacacagatgcagaagtgaagaaaggatactactttcttttatcctgcacatcagagcgggtacaccgtcagctacaagggagaccctgataatgcctcagggggactctaagcagagtgtactggaaatacagagtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcct

SEQ ID NO: 112809 - DNA, 563 bp, Homo sapiens
  Payload ID: 2073
  Gene Symbol: CDH2
  Gene Name: cadherin 2, type 1, N-cadherin (neuronal)
  ENST ID: ENST00000413878
  CDS Start-End: 345-563
agattgctgcagggaatctgtgagctcccagcatggaaaatgagatcaccaagcttcttttctgtggacctgtgactcccagatgggcggagtaggggacagggttgggcaccagctgctcagattattctttcaaatgcaggcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaag

SEQ ID NO: 112810 - DNA, 3882 bp, Homo sapiens
  Payload ID: 2074
  Gene Symbol: CDH20
  Gene Name: cadherin 20, type 2
  Uniprot ID: Q9HBT6
  ENST ID: ENST00000262717
  CDS Start-End: 399-2804
acttggcagtaccccccaactcctggcaaccgcacggagactttgcgaaacatccgaaggcagaaaagctgtgacacttctgacagagggggtaggggggtggggggcggggacagcgccgcgagcaggggtgaagagacccagcggggcaccagccgcccagtgggggaggcagctacgtgagcagaacgcccgccctggagcagttaggaccgaaggtctccggagagtcgccggcggtgccaggaagtcaacttcaagcagattgacttgaaacgggatctcatttaggaagcataagtgtccaatcaaaaactgtgtatttttttaaatttggaaaatactcaagttccagttgcttatcattctccttcattttctgaaaacctggcaatcccatgtggacttctggtagaatgagcaatgcaaagaactggcttggacttggcatgtccttgtacttctgggggctgatggaccttacgaccaccgttctctcggacaccccaacaccacaaggtgaattagaagcactcctgtcagacaagccacagtcacatcagcggaccaagaggagctgggtttggaaccagtttttcgttctggaagagtacactgggaccgaccctttgtatgtcggcaagcttcattcagatatggacaggggagacggatccatcaaatacatcctctcgggagaaggtgctggcatcgtgtttaccatcgacgacaccactggagacatccacgccattcagaggctcgaccgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtacctccgtcatccaagtgacagccacagatgcagatgacccgacctacggcaacagtgccagggtggtgtacagcattcttcagggccagccatatttttctgtggactctaaaacaggtgtaattaggacagcgctcatgaacatggacagagaagccaaagaatactacgaagtgattatccaagccaaggacatgggagggcagcttggaggattagctgggaccacaacagtcaacatcaccctctcagatgtcaatgataacccaccccgctttccccagaaacattaccagatgagtgtgttggaatcagctccaattagctccactgtcgggagagtgtttgccaaggacttggatgaaggcatcaatgcagagatgaaatatactattgtggatggagatggtgcagatgcctttgacattagcacagatcccaatttccaagttggtatcataactgtgaagaagcccctgagttttgaaagcaagaaaagctacaccttaaaggtggagggagccaatcctcacctagagatgcgttttctgaacttgggcccatttcaggacacaacaacagtgcacatcagtgtggaagacgtggacgagccccctgtgtttgaacctggcttttactttgtggaggtgcctgaggatgtggcgattggaacaaccatacagatcatttctgccaaggacccagatgtgaccaacaactcaatcagatactccattgatagaagcagtgaccctggaagatttttctatgttgacattacaacaggtgccctaatgacagcaagacccctagaccgggaagaattttcttggcataatatcactgtccttgctatggaaatgaacaatccctcccaggttggaagtgttcctgtcacaatcaaagtcttagatgtgaatgacaatgctccagagttccccagattctatgaagcttttgtctgtgagaacgccaaggcaggacagctgatccagacagtgagtgcggtggaccaagatgacccacgcaatggtcagcatttctactacagcttggctcctgaggctgctaacaaccccaactttaccataagggacaaccaagataacacagcacggattctaaccaggaggtctggtttccggcagcaggagcagagtgtctttcacctgcctatcctgatagcagatagcgggcagcccgtgctgagcagcacaggcacactgaccatccaagtgtgcagctgtgatgacgacggccacgtcatgtcctgcagcccagaggcctacatgctcccagtcagtttgagccggggcgccctcattgccatcctcgcctgcatctttgtcctcttagtgctggtgttgctcattttgtccatgaggcggcaccggaaacaaccatacatcatcgacgacgaggaaaacatccacgagaacatcgtccgctacgacgacgagggcggcggcgaggaggacaccgaggccttcgacatcgcggccatgtggaacccccgggaggcgcaggcgggggccgcccccaagacgcggcaggacatgctgcccgagatcgagagcctctcccgctacgtgcctcagacgtgcgcagtgaacagcactgtccacagctacgtgctggccaagctctacgaggccgacatggacctgtgggcaccgcccttcgactccctccagacgtatatgttcgagggggacggctctgtggcggggtcgctgagctccctgcagtcggccacgtcggactcggaacagagcttcgacttcctgacggactgggggccccgcttccggaagctggccgagctctacggggcgtcggagggacccgcgccgctgtggtgacggaagccaggaggcaggcgcgcgtccaaatccagacgttctccgcgggtgcttcgcggacaaggtgcagccaaccacacgagcaatactgtgctggagagtgagaatgggggtgagcaggcgaacagagctctctctggatcagctttacttgggtagattaagttaaataagcaaaaggaaacccagaaggaagagggcagaatctttaattacctttttttcttttctttttgatttttctgacactgtgtgcgaaggcttggagtccaaggtgttctgacaagggtggcttttctctgccattcgctaaggcctttgtcacttttccaccacagaaaggctctggccttggatacagagatgccaattgaaagcagaaagttctactctcgtatctgttttttatcttatcttattctccatttaagagttttgctggctcaaaccacagaaaccaacccacaagaaagaacaaaaaacttgttactcagtgaaattaacctacttgttctgggatggatggaatttcccgtaacccttttgagacaaggttaagactgaatcagccttgcatgggggtggatgggtgggagggtgggtgaaggaagagacattgactttatgctcaagtttagtggctgaaccaagagatgttggcattacagctcatccaacgccatcaagttagagtgctcgtgtctcctctcagctatttaactgtgcccctgcaaaattgttcagaatgaaaccagaaaaatctgcctcttttgcactgtagatgtctcttccatgtgccaaatgtggagattagatgctacaaatgaaagccaaataaaaaagaagtatctgacaaaagcatgggttagagggctttcctaatctgtgtgaggtcaatccaagggatgtttacatactgtagataacctacttgaacaaaaatcagtattatagagaataaatggatgtaagaaaattacatgtacaagttttgtatatttgttaataattttggtaataaatatgatgtactgcatctcagtaccttagcacttcttttaataaaagttaaatagaa

SEQ ID NO: 112811 - DNA, 2683 bp, Homo sapiens
  Payload ID: 2074
  Gene Symbol: CDH20
  Gene Name: cadherin 20, type 2
  Uniprot ID: Q9HBT6
  ENST ID: ENST00000538374
  CDS Start-End: 278-2683
gatgtgcgccgggaaggggaccagagagccaggctccggggaggcgcaggcacctacggggccgatccctggtccgtgcctcgcgccgcgcccccgccggagctcggctgtgggaggagaatgtggaagtcaacttcaagcagattgacttgaaacgggatctcatttaggaagcataagtgtccaatcaaaaactgtgtatttttttaaatttggaaaatactcaagttccagttgcttatcattctccttcattttctgaaaacctggcaatcccatgtggacttctggtagaatgagcaatgcaaagaactggcttggacttggcatgtccttgtacttctgggggctgatggaccttacgaccaccgttctctcggacaccccaacaccacaaggtgaattagaagcactcctgtcagacaagccacagtcacatcagcggaccaagaggagctgggtttggaaccagtttttcgttctggaagagtacactgggaccgaccctttgtatgtcggcaagcttcattcagatatggacaggggagacggatccatcaaatacatcctctcgggagaaggtgctggcatcgtgtttaccatcgacgacaccactggagacatccacgccattcagaggctcgaccgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtacctccgtcatccaagtgacagccacagatgcagatgacccgacctacggcaacagtgccagggtggtgtacagcattcttcagggccagccatatttttctgtggactctaaaacaggtgtaattaggacagcgctcatgaacatggacagagaagccaaagaatactacgaagtgattatccaagccaaggacatgggagggcagcttggaggattagctgggaccacaacagtcaacatcaccctctcagatgtcaatgataacccaccccgctttccccagaaacattaccagatgagtgtgttggaatcagctccaattagctccactgtcgggagagtgtttgccaaggacttggatgaaggcatcaatgcagagatgaaatatactattgtggatggagatggtgcagatgcctttgacattagcacagatcccaatttccaagttggtatcataactgtgaagaagcccctgagttttgaaagcaagaaaagctacaccttaaaggtggagggagccaatcctcacctagagatgcgttttctgaacttgggcccatttcaggacacaacaacagtgcacatcagtgtggaagacgtggacgagccccctgtgtttgaacctggcttttactttgtggaggtgcctgaggatgtggcgattggaacaaccatacagatcatttctgccaaggacccagatgtgaccaacaactcaatcagatactccattgatagaagcagtgaccctggaagatttttctatgttgacattacaacaggtgccctaatgacagcaagacccctagaccgggaagaattttcttggcataatatcactgtccttgctatggaaatgaacaatccctcccaggttggaagtgttcctgtcacaatcaaagtcttagatgtgaatgacaatgctccagagttccccagattctatgaagcttttgtctgtgagaacgccaaggcaggacagctgatccagacagtgagtgcggtggaccaagatgacccacgcaatggtcagcatttctactacagcttggctcctgaggctgctaacaaccccaactttaccataagggacaaccaagataacacagcacggattctaaccaggaggtctggtttccggcagcaggagcagagtgtctttcacctgcctatcctgatagcagatagcgggcagcccgtgctgagcagcacaggcacactgaccatccaagtgtgcagctgtgatgacgacggccacgtcatgtcctgcagcccagaggcctacatgctcccagtcagtttgagccggggcgccctcattgccatcctcgcctgcatctttgtcctcttagtgctggtgttgctcattttgtccatgaggcggcaccggaaacaaccatacatcatcgacgacgaggaaaacatccacgagaacatcgtccgctacgacgacgagggcggcggcgaggaggacaccgaggccttcgacatcgcggccatgtggaacccccgggaggcgcaggcgggggccgcccccaagacgcggcaggacatgctgcccgagatcgagagcctctcccgctacgtgcctcagacgtgcgcagtgaacagcactgtccacagctacgtgctggccaagctctacgaggccgacatggacctgtgggcaccgcccttcgactccctccagacgtatatgttcgagggggacggctctgtggcggggtcgctgagctccctgcagtcggccacgtcggactcggaacagagcttcgacttcctgacggactgggggccccgcttccggaagctggccgagctctacggggcgtcggagggacccgcgccgctgtggtga

SEQ ID NO: 112812 - DNA, 2855 bp, Homo sapiens
  Payload ID: 2074
  Gene Symbol: CDH20
  Gene Name: cadherin 20, type 2
  Uniprot ID: Q9HBT6
  ENST ID: ENST00000536675
  CDS Start-End: 13-2418
cctggcaatcccatgtggacttctggtagaatgagcaatgcaaagaactggcttggacttggcatgtccttgtacttctgggggctgatggaccttacgaccaccgttctctcggacaccccaacaccacaaggtgaattagaagcactcctgtcagacaagccacagtcacatcagcggaccaagaggagctgggtttggaaccagtttttcgttctggaagagtacactgggaccgaccctttgtatgtcggcaagcttcattcagatatggacaggggagacggatccatcaaatacatcctctcgggagaaggtgctggcatcgtgtttaccatcgacgacaccactggagacatccacgccattcagaggctcgaccgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtacctccgtcatccaagtgacagccacagatgcagatgacccgacctacggcaacagtgccagggtggtgtacagcattcttcagggccagccatatttttctgtggactctaaaacaggtgtaattaggacagcgctcatgaacatggacagagaagccaaagaatactacgaagtgattatccaagccaaggacatgggagggcagcttggaggattagctgggaccacaacagtcaacatcaccctctcagatgtcaatgataacccaccccgctttccccagaaacattaccagatgagtgtgttggaatcagctccaattagctccactgtcgggagagtgtttgccaaggacttggatgaaggcatcaatgcagagatgaaatatactattgtggatggagatggtgcagatgcctttgacattagcacagatcccaatttccaagttggtatcataactgtgaagaagcccctgagttttgaaagcaagaaaagctacaccttaaaggtggagggagccaatcctcacctagagatgcgttttctgaacttgggcccatttcaggacacaacaacagtgcacatcagtgtggaagacgtggacgagccccctgtgtttgaacctggcttttactttgtggaggtgcctgaggatgtggcgattggaacaaccatacagatcatttctgccaaggacccagatgtgaccaacaactcaatcagatactccattgatagaagcagtgaccctggaagatttttctatgttgacattacaacaggtgccctaatgacagcaagacccctagaccgggaagaattttcttggcataatatcactgtccttgctatggaaatgaacaatccctcccaggttggaagtgttcctgtcacaatcaaagtcttagatgtgaatgacaatgctccagagttccccagattctatgaagcttttgtctgtgagaacgccaaggcaggacagctgatccagacagtgagtgcggtggaccaagatgacccacgcaatggtcagcatttctactacagcttggctcctgaggctgctaacaaccccaactttaccataagggacaaccaagataacacagcacggattctaaccaggaggtctggtttccggcagcaggagcagagtgtctttcacctgcctatcctgatagcagatagcgggcagcccgtgctgagcagcacaggcacactgaccatccaagtgtgcagctgtgatgacgacggccacgtcatgtcctgcagcccagaggcctacatgctcccagtcagtttgagccggggcgccctcattgccatcctcgcctgcatctttgtcctcttagtgctggtgttgctcattttgtccatgaggcggcaccggaaacaaccatacatcatcgacgacgaggaaaacatccacgagaacatcgtccgctacgacgacgagggcggcggcgaggaggacaccgaggccttcgacatcgcggccatgtggaacccccgggaggcgcaggcgggggccgcccccaagacgcggcaggacatgctgcccgagatcgagagcctctcccgctacgtgcctcagacgtgcgcagtgaacagcactgtccacagctacgtgctggccaagctctacgaggccgacatggacctgtgggcaccgcccttcgactccctccagacgtatatgttcgagggggacggctctgtggcggggtcgctgagctccctgcagtcggccacgtcggactcggaacagagcttcgacttcctgacggactgggggccccgcttccggaagctggccgagctctacggggcgtcggagggacccgcgccgctgtggtgacggaagccaggaggcaggcgcgcgtccaaatccagacgttctccgcgggtgcttcgcggacaaggtgcagccaaccacacgagcaatactgtgctggagagtgagaatgggggtgagcaggcgaacagagctctctctggatcagctttacttgggtagattaagttaaataagcaaaaggaaacccagaaggaagagggcagaatctttaattacctttttttcttttctttttgatttttctgacactgtgtgcgaaggcttggagtccaaggtgttctgacaagggtggcttttctctgccattcgctaaggcctttgtcacttttccaccacagaaaggctctggccttggatacagagatgccaattgaaagcagaaagttctactctcgtatctgttttttatcttatcttattctccatttaagagtttt

SEQ ID NO: 112813 - DNA, 3661 bp, Homo sapiens
  Payload ID: 2075
  Gene Symbol: CDH22
  Gene Name: cadherin 22, type 2
  Uniprot ID: Q9UJ99
  ENST ID: ENST00000372262
  CDS Start-End: 402-2888
aggctcctgatggaaagggaaggcccctagtcctggcaggatctgccggccccaacccgcatcctttctgcgcaggaaccatggcgcttccccgactctggagctgtccaggtgctgcctggtgatccgcacgcgacgcggcgacgggggcgcgggcgggcaccccgggggctgtccatgccccggatgcggccgcgccccctccccctccagccgggtacccccgcggctgggcggcgttcagggccgcgggcccgtccgggtgccccgtcgggggcgacatcccggcggccgcgctgaggccaccatgtgacacggcgccgcatcgttgtgcgaccaagcagcggcgccctggtgcctctcgtccatgctcctgggccccagccccgcgcaggccaaggatgaggccgaggcccgaaggtagggggctccgggcgggagtcgcgctgtcccccgcgctactgctgctgctgctgctgccgccgccgccgacgctgctggggcgcctgtgggcagcgggcacaccctcgccgtcggcgcccggagctcggcaggacggcgcgctgggagccggccgcgtcaaacgcggctgggtgtggaaccagttcttcgtggtagaggagtacacgggcacggagcccctgtatgtgggcaagatccactccgactcagacgagggtgacggggccatcaagtacaccatctcaggcgagggtgctgggaccatcttcctgatcgacgagctgacaggcgacattcatgccatggagcgcctggaccgcgagcagaaaaccttctacacgctgcgggcccaggctcgggatcgcgccaccaaccgcctactggagcccgagtcggagttcatcatcaaggtgcaggacatcaatgacagtgagccccgcttcctgcacggcccctatattggcagcgtggccgagctctcacctacaggcacgtcggtgatgcaggtgatggcctcggatgcggatgaccccacgtacggcagcagcgctcggctggtgtacagcgtgctggacggcgagcaccacttcaccgtggaccccaagaccggcgtaatccggacggctgtgcctgaccttgaccgcgagagccaggagcgctacgaggtggtgatccaggccacagacatggcgggtcagctgggtggcctctcgggctccactaccgtcaccatcgtagtcaccgacgtcaatgacaacccgccccgtttcccgcagaagatgtaccagttcagcatccaggagtcagcccccattggaacggctgtgggacgtgtgaaggctgaggactcagacgtgggagagaacacagacatgacttaccaccttaaggacgagagcagcagcggcggcgatgtgttcaaggtcaccacagacagcgacactcaggaggccatcatcgtagtgcagaagcgcctggacttcgaatcccagcccgtgcacaccgtgatcctggaggccctcaacaagttcgtggacccccgcttcgccgacctgggcacgttccgcgaccaggcgatcgtgcgcgtggccgtgaccgacgtggacgagccccccgagttccggccgccctccggcctcctggaggtgcaggaggacgcgcaggtgggctccctggtcggcgtggtgacggcgcgggaccccgacgccgccaaccggcccgtccggtacgccattgaccgcgaatcagatttggaccagatcttcgatatcgatgcggacacaggcgccatcgtgactggcaaggggctggaccgcgagacggccggctggcacaacatcacagtgctggccatggaggcggacaatcatgcacagctatcccgggcatccctaaggatccgaatcctggatgtgaacgacaatcccccagaactggccacaccctacgaggcagctgtatgcgaggatgccaagccaggccagctcatccagaccatcagcgtggtggacagagacgagccccaaggcgggcaccgcttctatttccgcctggtgcctgaagctcccagcaaccctcatttctctctgcttgacatccaagacaacaccgctgcagtgcacacgcagcacgtgggcttcaaccggcaggagcaggacgtgttcttcctgcccatcctggtggtagacagtgggccgcccacactgagcagcacaggcacgctcaccatccgcatctgtggctgcgacagctccggcaccatccagtcctgcaacaccacggcctttgtcatggccgcctccctcagccccggcgccctcatcgccctcttggtctgcgttctcatcctggttgtgctggtgctgctgatcctcaccctcaggcgccaccacaagagccacctgagctcggacgaggatgaagacatgcgggacaacgtcatcaaatacaacgacgaaggcggcggcgagcaggacaccgaagcctacgacatgtcggcgctgcggagcctctacgacttcggcgagctcaagggcggcgacgggggcggcagcgcgggcgggggagcgggcgggggctcgggcgggggcgcgggcagccccccgcaggcccacctgccctccgagcgccactcgctgccgcaggggccgccgagccccgagccagacttctcagtgttcagggacttcatcagccgcaaggtggcactggcggacggggacctgtcggtgccgccctacgacgccttccagacctacgccttcgagggcgcggactcgccggccgcctcgctcagctccctgcacagcggctcgtcgggctccgagcaggacttcgcctatctcagcagctggggtccgcgcttccggcccctggccgcgctctacgccggccaccgcggggacgacgaggcccaggcctcctagcccctcgccctgccgtcggggcgcggctgctcacccgcccagcacacgccggggccccaggacaacgcgtttcccccgcggaccccctttcctgccctcccccaaccctcccttggcggctggacggaggggggacttgctaggagcggactcttccattcctcctcctctaggggtgcagctttggagcccagaggtgcgggattctgaccaacggcattaaaactgaggcgagaccgggcacggtgtggctctggggttagaatgggagatgggggtggcgttgcagagtcgggaaggggcgggtcactcaatcctggcctgggggagaatgctggagggagcacgccgctgagatgcccccaccccaggtttcccccatcagagttaagaggaaagaaggctgttcacttactaagcacctactgtgtgctgggacgctgtacagagaccagctcagtcgtcagagaaaccatgaggtggtgtcctgcacggaatagaaggggaaaggaccccagagaagtggctgtgacccgtccaagggcacctggccagtgaatggcagagcctctggcactgaccagctgcctggcctcgggcaagtcacttcacttctctggtcctcagtttcctcatctgtcaaatggggttaataacagaacctacctcgaagagttgtgaggctaaaaagggttcatatgtgtcaagtggttaggacagtgcctggcacatagtaggtgttcaataaatgctagcctttgttactattctta

SEQ ID NO: 112814 - DNA, 3902 bp, Homo sapiens
  Payload ID: 2075
  Gene Symbol: CDH22
  Gene Name: cadherin 22, type 2
  Uniprot ID: Q9UJ99
  ENST ID: ENST00000537909
  CDS Start-End: 644-3130
agacacgcacactccctcgctcccgctcgctcgctcactccctcgctctctcgctctctcgctctctcgctcacacacacgcgcgcacacgccgccgcggctccccctctcgctcccgctctccctccggctcctgcgggcggccgcggggctccggactcgcccgctgcccgcgccggggctcccgccccacgcagcgtcccgaggcggcaggactagggggagccccgggccgctccccgaggctcctgatggaaagggaaggcccctagtcctggcaggatctgccggccccaacccgcatcctttctgcgcaggaaccatggcgcttccccgactctggagctgtccaggtgctgcctggtgatccgcacgcgacgcggcgacgggggcgcgggcgggcaccccgggggctgtccatgccccggatgcggccgcgccccctccccctccagccgggtacccccgcggctgggcggcgttcagggccgcgggcccgtccgggtgccccgtcgggggcgacatcccggcggccgcgctgaggccaccatgtgacacggcgccgcatcgttgtgcgaccaagcagcggcgccctggtgcctctcgtccatgctcctgggccccagccccgcgcaggccaaggatgaggccgaggcccgaaggtagggggctccgggcgggagtcgcgctgtcccccgcgctactgctgctgctgctgctgccgccgccgccgacgctgctggggcgcctgtgggcagcgggcacaccctcgccgtcggcgcccggagctcggcaggacggcgcgctgggagccggccgcgtcaaacgcggctgggtgtggaaccagttcttcgtggtagaggagtacacgggcacggagcccctgtatgtgggcaagatccactccgactcagacgagggtgacggggccatcaagtacaccatctcaggcgagggtgctgggaccatcttcctgatcgacgagctgacaggcgacattcatgccatggagcgcctggaccgcgagcagaaaaccttctacacgctgcgggcccaggctcgggatcgcgccaccaaccgcctactggagcccgagtcggagttcatcatcaaggtgcaggacatcaatgacagtgagccccgcttcctgcacggcccctatattggcagcgtggccgagctctcacctacaggcacgtcggtgatgcaggtgatggcctcggatgcggatgaccccacgtacggcagcagcgctcggctggtgtacagcgtgctggacggcgagcaccacttcaccgtggaccccaagaccggcgtaatccggacggctgtgcctgaccttgaccgcgagagccaggagcgctacgaggtggtgatccaggccacagacatggcgggtcagctgggtggcctctcgggctccactaccgtcaccatcgtagtcaccgacgtcaatgacaacccgccccgtttcccgcagaagatgtaccagttcagcatccaggagtcagcccccattggaacggctgtgggacgtgtgaaggctgaggactcagacgtgggagagaacacagacatgacttaccaccttaaggacgagagcagcagcggcggcgatgtgttcaaggtcaccacagacagcgacactcaggaggccatcatcgtagtgcagaagcgcctggacttcgaatcccagcccgtgcacaccgtgatcctggaggccctcaacaagttcgtggacccccgcttcgccgacctgggcacgttccgcgaccaggcgatcgtgcgcgtggccgtgaccgacgtggacgagccccccgagttccggccgccctccggcctcctggaggtgcaggaggacgcgcaggtgggctccctggtcggcgtggtgacggcgcgggaccccgacgccgccaaccggcccgtccggtacgccattgaccgcgaatcagatttggaccagatcttcgatatcgatgcggacacaggcgccatcgtgactggcaaggggctggaccgcgagacggccggctggcacaacatcacagtgctggccatggaggcggacaatcatgcacagctatcccgggcatccctaaggatccgaatcctggatgtgaacgacaatcccccagaactggccacaccctacgaggcagctgtatgcgaggatgccaagccaggccagctcatccagaccatcagcgtggtggacagagacgagccccaaggcgggcaccgcttctatttccgcctggtgcctgaagctcccagcaaccctcatttctctctgcttgacatccaagacaacaccgctgcagtgcacacgcagcacgtgggcttcaaccggcaggagcaggacgtgttcttcctgcccatcctggtggtagacagtgggccgcccacactgagcagcacaggcacgctcaccatccgcatctgtggctgcgacagctccggcaccatccagtcctgcaacaccacggcctttgtcatggccgcctccctcagccccggcgccctcatcgccctcttggtctgcgttctcatcctggttgtgctggtgctgctgatcctcaccctcaggcgccaccacaagagccacctgagctcggacgaggatgaagacatgcgggacaacgtcatcaaatacaacgacgaaggcggcggcgagcaggacaccgaagcctacgacatgtcggcgctgcggagcctctacgacttcggcgagctcaagggcggcgacgggggcggcagcgcgggcgggggagcgggcgggggctcgggcgggggcgcgggcagccccccgcaggcccacctgccctccgagcgccactcgctgccgcaggggccgccgagccccgagccagacttctcagtgttcagggacttcatcagccgcaaggtggcactggcggacggggacctgtcggtgccgccctacgacgccttccagacctacgccttcgagggcgcggactcgccggccgcctcgctcagctccctgcacagcggctcgtcgggctccgagcaggacttcgcctatctcagcagctggggtccgcgcttccggcccctggccgcgctctacgccggccaccgcggggacgacgaggcccaggcctcctagcccctcgccctgccgtcggggcgcggctgctcacccgcccagcacacgccggggccccaggacaacgcgtttcccccgcggaccccctttcctgccctcccccaaccctcccttggcggctggacggaggggggacttgctaggagcggactcttccattcctcctcctctaggggtgcagctttggagcccagaggtgcgggattctgaccaacggcattaaaactgaggcgagaccgggcacggtgtggctctggggttagaatgggagatgggggtggcgttgcagagtcgggaaggggcgggtcactcaatcctggcctgggggagaatgctggagggagcacgccgctgagatgcccccaccccaggtttcccccatcagagttaagaggaaagaaggctgttcacttactaagcacctactgtgtgctgggacgctgtacagagaccagctcagtcgtcagagaaaccatgaggtggtgtcctgcacggaatagaaggggaaaggaccccagagaagtggctgtgacccgtccaagggcacctggccagtgaatggcagagcctctggcactgaccagctgcctggcctcgggcaagtcacttcacttctctggtcctcagtttcctcatctgtcaaatggggttaataacagaacctacctcgaagagttgtgaggctaaaaagggttcatatgtgtcaagtggttaggacagtgcctggcacatagtaggtgttcaataaatgctagcctttgttactattctt

SEQ ID NO: 112815 - DNA, 2873 bp, Homo sapiens
  Payload ID: 2076
  Gene Symbol: CDH24
  Gene Name: cadherin 24, type 2
  Uniprot ID: Q86UP0
  ENST ID: ENST00000267383
  CDS Start-End: 94-2553
tgcccctccaccccagccagctcatgggccacgtggcctggcccagcctcagcacccagggccagtgaacagagccctggctggagtccaaacatgtggggcctggtgaggctcctgctggcctggctgggtggctggggctgcatggggcgtctggcagccccagcccgggcctgggcagggtcccgggaacacccagggcctgctctgctgcggactcgaaggagctgggtctggaaccagttctttgtcattgaggaatatgctggtccagagcctgttctcattggcaagctgcactcggatgttgaccggggagagggccgcaccaagtacctgttgaccggggagggggcaggcaccgtatttgtgattgatgaggccacaggcaatattcatgttaccaagagccttgaccgggaggaaaaggcgcaatatgtgctactggcccaagccgtggaccgagcctccaaccggcccctggagcccccatcagagttcatcatcaaagtgcaagacatcaacgacaatccacccatttttccccttgggccctaccatgccaccgtgcccgagatgtccaatgtcgggacatcagtgatccaggtgactgctcacgatgctgatgaccccagctatgggaacagtgccaagctggtgtacactgttctggatggactgcctttcttctctgtggacccccagactggagtggtgcgtacagccatccccaacatggaccgggagacacaggaggagttcttggtggtgatccaggccaaggacatgggcggccacatgggggggctgtcaggcagcactacggtgactgtcacgctcagcgatgtcaacgacaacccccccaagttcccacagagcctataccagttctccgtggtggagacagctggacctggcacactggtgggccggctccgggcccaggacccagacctgggggacaacgccctgatggcatacagcatcctggatggggaggggtctgaggccttcagcatcagcacagacttgcagggtcgagacgggctcctcactgtccgcaagcccctagactttgagagccagcgctcctactccttccgtgtcgaggccaccaacacgctcattgacccagcctatctgcggcgagggcccttcaaggatgtggcctctgtgcgtgtggcagtgcaagatgccccagagccacctgccttcacccaggctgcctaccacctgacagtgcctgagaacaaggccccggggaccctggtaggccagatctccgcggctgacctggactcccctgccagcccaatcagatactccatcctcccccactcagatccggagcgttgcttctctatccagcccgaggaaggcaccatccatacagcagcacccctggatcgcgaggctcgcgcctggcacaacctcactgtgctggctacagagctcggctggagctgggggccagaaaggggctgggtacctcttctggttgctgagtggagtgcaccagcagccccaccccagagaagccctgttggaagcgctgtgggaatcccccaagacagttctgcacaggcctcgcgcgtgcaagtggccatccagaccctggatgagaatgacaatgctccccagctggctgagccctacgatacttttgtgtgtgactctgcagctcctggccagctgattcaggtcatccgggccctggacagagatgaagttggcaacagtagccatgtctcctttcaaggtcctctgggccctgatgccaactttactgtccaggacaaccgagatggctccgccagcctgctgctgccctcccgccctgctccaccccgccatgccccctacttggttcccatagaactgtgggactgggggcagccggcgctgagcagcactgccacagtgactgttagtgtgtgccgctgccagcctgacggctctgtggcatcctgctggcctgaggctcacctctcagctgctgggctcagcaccggcgccctgcttgccatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgca

SEQ ID NO: 112816 - DNA, 3552 bp, Homo sapiens
  Payload ID: 2076
  Gene Symbol: CDH24
  Gene Name: cadherin 24, type 2
  Uniprot ID: Q86UP0
  ENST ID: ENST00000397359
  CDS Start-End: 261-2720
ttctcgccggggccgctcagacctgcagcggagccgcggcgcccgctccaatcggctcggggctgtgcccccgggacccggcgacgggggcgggcgggggcgcttcccgccggcctgggcccctcggcagtgccaggtgtggatccatggggtagcctcaacgcatctgcccctccaccccagccagctcatgggccacgtggcctggcccagcctcagcacccagggccagtgaacagagccctggctggagtccaaacatgtggggcctggtgaggctcctgctggcctggctgggtggctggggctgcatggggcgtctggcagccccagcccgggcctgggcagggtcccgggaacacccagggcctgctctgctgcggactcgaaggagctgggtctggaaccagttctttgtcattgaggaatatgctggtccagagcctgttctcattggcaagctgcactcggatgttgaccggggagagggccgcaccaagtacctgttgaccggggagggggcaggcaccgtatttgtgattgatgaggccacaggcaatattcatgttaccaagagccttgaccgggaggaaaaggcgcaatatgtgctactggcccaagccgtggaccgagcctccaaccggcccctggagcccccatcagagttcatcatcaaagtgcaagacatcaacgacaatccacccatttttccccttgggccctaccatgccaccgtgcccgagatgtccaatgtcgggacatcagtgatccaggtgactgctcacgatgctgatgaccccagctatgggaacagtgccaagctggtgtacactgttctggatggactgcctttcttctctgtggacccccagactggagtggtgcgtacagccatccccaacatggaccgggagacacaggaggagttcttggtggtgatccaggccaaggacatgggcggccacatgggggggctgtcaggcagcactacggtgactgtcacgctcagcgatgtcaacgacaacccccccaagttcccacagagcctataccagttctccgtggtggagacagctggacctggcacactggtgggccggctccgggcccaggacccagacctgggggacaacgccctgatggcatacagcatcctggatggggaggggtctgaggccttcagcatcagcacagacttgcagggtcgagacgggctcctcactgtccgcaagcccctagactttgagagccagcgctcctactccttccgtgtcgaggccaccaacacgctcattgacccagcctatctgcggcgagggcccttcaaggatgtggcctctgtgcgtgtggcagtgcaagatgccccagagccacctgccttcacccaggctgcctaccacctgacagtgcctgagaacaaggccccggggaccctggtaggccagatctccgcggctgacctggactcccctgccagcccaatcagatactccatcctcccccactcagatccggagcgttgcttctctatccagcccgaggaaggcaccatccatacagcagcacccctggatcgcgaggctcgcgcctggcacaacctcactgtgctggctacagagctcggctggagctgggggccagaaaggggctgggtacctcttctggttgctgagtggagtgcaccagcagccccaccccagagaagccctgttggaagcgctgtgggaatcccccaagacagttctgcacaggcctcgcgcgtgcaagtggccatccagaccctggatgagaatgacaatgctccccagctggctgagccctacgatacttttgtgtgtgactctgcagctcctggccagctgattcaggtcatccgggccctggacagagatgaagttggcaacagtagccatgtctcctttcaaggtcctctgggccctgatgccaactttactgtccaggacaaccgagatggctccgccagcctgctgctgccctcccgccctgctccaccccgccatgccccctacttggttcccatagaactgtgggactgggggcagccggcgctgagcagcactgccacagtgactgttagtgtgtgccgctgccagcctgacggctctgtggcatcctgctggcctgaggctcacctctcagctgctgggctcagcaccggcgccctgcttgccatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgcagttctgaagctcacacatagtctccctgcgtcttccttgcccatacacatgctctgtgtctgtctcctgcccacatctcccttccttctctctgggtccctgtgactggctttttgtttttttctgttgtccatcccaaaatcaagagaaacttccagccactgctgcccaccctcctgcaggggatgttgtgccccagacctgcctgcatggttccatccattactcatggcctcagcctcatcctggctccactggcctccagctgagagagggaaccagcctgcctcccagggcaagagctccagcctcccgtgtggccgcctccctggagctctgcccagctgtcagcttcccctgggcatcccagccctgggcattgtcttgtgtgcttcctgagggagtagggaaaggaaagggggaggcggctggggaaggggaaagagggaggaaggggaggggcctccatctctaatttcataataaacaaacactttattttgtaaagctgg

SEQ ID NO: 112817 - DNA, 3438 bp, Homo sapiens
  Payload ID: 2076
  Gene Symbol: CDH24
  Gene Name: cadherin 24, type 2
  Uniprot ID: Q86UP0
  ENST ID: ENST00000487137
  CDS Start-End: 261-2606
ttctcgccggggccgctcagacctgcagcggagccgcggcgcccgctccaatcggctcggggctgtgcccccgggacccggcgacgggggcgggcgggggcgcttcccgccggcctgggcccctcggcagtgccaggtgtggatccatggggtagcctcaacgcatctgcccctccaccccagccagctcatgggccacgtggcctggcccagcctcagcacccagggccagtgaacagagccctggctggagtccaaacatgtggggcctggtgaggctcctgctggcctggctgggtggctggggctgcatggggcgtctggcagccccagcccgggcctgggcagggtcccgggaacacccagggcctgctctgctgcggactcgaaggagctgggtctggaaccagttctttgtcattgaggaatatgctggtccagagcctgttctcattggcaagctgcactcggatgttgaccggggagagggccgcaccaagtacctgttgaccggggagggggcaggcaccgtatttgtgattgatgaggccacaggcaatattcatgttaccaagagccttgaccgggaggaaaaggcgcaatatgtgctactggcccaagccgtggaccgagcctccaaccggcccctggagcccccatcagagttcatcatcaaagtgcaagacatcaacgacaatccacccatttttccccttgggccctaccatgccaccgtgcccgagatgtccaatgtcgggacatcagtgatccaggtgactgctcacgatgctgatgaccccagctatgggaacagtgccaagctggtgtacactgttctggatggactgcctttcttctctgtggacccccagactggagtggtgcgtacagccatccccaacatggaccgggagacacaggaggagttcttggtggtgatccaggccaaggacatgggcggccacatgggggggctgtcaggcagcactacggtgactgtcacgctcagcgatgtcaacgacaacccccccaagttcccacagagcctataccagttctccgtggtggagacagctggacctggcacactggtgggccggctccgggcccaggacccagacctgggggacaacgccctgatggcatacagcatcctggatggggaggggtctgaggccttcagcatcagcacagacttgcagggtcgagacgggctcctcactgtccgcaagcccctagactttgagagccagcgctcctactccttccgtgtcgaggccaccaacacgctcattgacccagcctatctgcggcgagggcccttcaaggatgtggcctctgtgcgtgtggcagtgcaagatgccccagagccacctgccttcacccaggctgcctaccacctgacagtgcctgagaacaaggccccggggaccctggtaggccagatctccgcggctgacctggactcccctgccagcccaatcagatactccatcctcccccactcagatccggagcgttgcttctctatccagcccgaggaaggcaccatccatacagcagcacccctggatcgcgaggctcgcgcctggcacaacctcactgtgctggctacagagctcgacagttctgcacaggcctcgcgcgtgcaagtggccatccagaccctggatgagaatgacaatgctccccagctggctgagccctacgatacttttgtgtgtgactctgcagctcctggccagctgattcaggtcatccgggccctggacagagatgaagttggcaacagtagccatgtctcctttcaaggtcctctgggccctgatgccaactttactgtccaggacaaccgagatggctccgccagcctgctgctgccctcccgccctgctccaccccgccatgccccctacttggttcccatagaactgtgggactgggggcagccggcgctgagcagcactgccacagtgactgttagtgtgtgccgctgccagcctgacggctctgtggcatcctgctggcctgaggctcacctctcagctgctgggctcagcaccggcgccctgcttgccatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgcagttctgaagctcacacatagtctccctgcgtcttccttgcccatacacatgctctgtgtctgtctcctgcccacatctcccttccttctctctgggtccctgtgactggctttttgtttttttctgttgtccatcccaaaatcaagagaaacttccagccactgctgcccaccctcctgcaggggatgttgtgccccagacctgcctgcatggttccatccattactcatggcctcagcctcatcctggctccactggcctccagctgagagagggaaccagcctgcctcccagggcaagagctccagcctcccgtgtggccgcctccctggagctctgcccagctgtcagcttcccctgggcatcccagccctgggcattgtcttgtgtgcttcctgagggagtagggaaaggaaagggggaggcggctggggaaggggaaagagggaggaaggggaggggcctccatctctaatttcataataaacaaacactttattttgtaaagctgg

SEQ ID NO: 112818 - DNA, 2759 bp, Homo sapiens
  Payload ID: 2076
  Gene Symbol: CDH24
  Gene Name: cadherin 24, type 2
  Uniprot ID: Q86UP0
  ENST ID: ENST00000554034
  CDS Start-End: 94-2439
tgcccctccaccccagccagctcatgggccacgtggcctggcccagcctcagcacccagggccagtgaacagagccctggctggagtccaaacatgtggggcctggtgaggctcctgctggcctggctgggtggctggggctgcatggggcgtctggcagccccagcccgggcctgggcagggtcccgggaacacccagggcctgctctgctgcggactcgaaggagctgggtctggaaccagttctttgtcattgaggaatatgctggtccagagcctgttctcattggcaagctgcactcggatgttgaccggggagagggccgcaccaagtacctgttgaccggggagggggcaggcaccgtatttgtgattgatgaggccacaggcaatattcatgttaccaagagccttgaccgggaggaaaaggcgcaatatgtgctactggcccaagccgtggaccgagcctccaaccggcccctggagcccccatcagagttcatcatcaaagtgcaagacatcaacgacaatccacccatttttccccttgggccctaccatgccaccgtgcccgagatgtccaatgtcgggacatcagtgatccaggtgactgctcacgatgctgatgaccccagctatgggaacagtgccaagctggtgtacactgttctggatggactgcctttcttctctgtggacccccagactggagtggtgcgtacagccatccccaacatggaccgggagacacaggaggagttcttggtggtgatccaggccaaggacatgggcggccacatgggggggctgtcaggcagcactacggtgactgtcacgctcagcgatgtcaacgacaacccccccaagttcccacagagcctataccagttctccgtggtggagacagctggacctggcacactggtgggccggctccgggcccaggacccagacctgggggacaacgccctgatggcatacagcatcctggatggggaggggtctgaggccttcagcatcagcacagacttgcagggtcgagacgggctcctcactgtccgcaagcccctagactttgagagccagcgctcctactccttccgtgtcgaggccaccaacacgctcattgacccagcctatctgcggcgagggcccttcaaggatgtggcctctgtgcgtgtggcagtgcaagatgccccagagccacctgccttcacccaggctgcctaccacctgacagtgcctgagaacaaggccccggggaccctggtaggccagatctccgcggctgacctggactcccctgccagcccaatcagatactccatcctcccccactcagatccggagcgttgcttctctatccagcccgaggaaggcaccatccatacagcagcacccctggatcgcgaggctcgcgcctggcacaacctcactgtgctggctacagagctcgacagttctgcacaggcctcgcgcgtgcaagtggccatccagaccctggatgagaatgacaatgctccccagctggctgagccctacgatacttttgtgtgtgactctgcagctcctggccagctgattcaggtcatccgggccctggacagagatgaagttggcaacagtagccatgtctcctttcaaggtcctctgggccctgatgccaactttactgtccaggacaaccgagatggctccgccagcctgctgctgccctcccgccctgctccaccccgccatgccccctacttggttcccatagaactgtgggactgggggcagccggcgctgagcagcactgccacagtgactgttagtgtgtgccgctgccagcctgacggctctgtggcatcctgctggcctgaggctcacctctcagctgctgggctcagcaccggcgccctgcttgccatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgca

SEQ ID NO: 112819 - DNA, 2037 bp, Homo sapiens
  Payload ID: 2076
  Gene Symbol: CDH24
  Gene Name: cadherin 24, type 2
  ENST ID: ENST00000610348
  CDS Start-End: 261-1205
ttctcgccggggccgctcagacctgcagcggagccgcggcgcccgctccaatcggctcggggctgtgcccccgggacccggcgacgggggcgggcgggggcgcttcccgccggcctgggcccctcggcagtgccaggtgtggatccatggggtagcctcaacgcatctgcccctccaccccagccagctcatgggccacgtggcctggcccagcctcagcacccagggccagtgaacagagccctggctggagtccaaacatgtggggcctggtgaggctcctgctggcctggctgggtggctggggctgcatggggcgtctggcagccccagcccgggcctgggcagggtcccgggaacacccagggcctgctctgctgcggactcgaaggagctgggtctggaaccagttctttgtcattgaggaatatgctggtccagagcctgttctcattggcaagctgcactcggatgttgaccggggagagggccgcaccaagtacctgttgaccggggagggggcaggcaccgtatttgtgattgatgaggccacaggcaatattcatgttaccaagagccttgaccgggaggaaaaggcgcaatatgtgctactggcccaagccgtggaccgagcctccaaccggcccctggagcccccatcagagttcatcatcaaaatcatcacctgtgtgggtgccctgcttgccctggtggtgctcttcgtggccctgcggcggcagaagcaagaagcactgatggtactggaggaggaggacgtccgagagaacatcatcacctacgacgacgagggcggcggcgaggaggacaccgaggccttcgacatcacggccttgcagaacccggacggggcggcccccccggcgcccggccctcccgcgcgccgagacgtgttgccccgggcccgggtgtcgcgccagcccagaccccccggccccgccgacgtggcgcagctcctggcgctgcggctccgcgaggcggacgaggaccccggcgtacccccgtacgactcggtgcaggtgtacggctacgagggccgcggctcctcttgcggctccctcagctccctgggctccggcagcgaagccggcggcgcccccggccccgcggagccgctggacgactggggtccgctcttccgcaccctggccgagctgtatggggccaaggagcccccggccccctgagcgcccgggctggcccggcccaccgcggggggggggcagcgggcacaggccctctgagtgagccccacggggtccaggcgggcggcagcagcccaggggccccaggcctcctccctgtccttgtgtccctccttgcttccccggggcaccctcgctctcacctccctcctcctgagtcggtgtgtgtgtctctctccaggaatctttgtctctatctgtgacacgctcctctgtccgggcctgggtttcctgccctggccctggccctgcgatctctcactgtgattcctctccttcctccgtggcgttttgtctctgcagttctgaagctcacacatagtctccctgcgtcttccttgcccatacacatgctctgtgtctgtctcctgcccacatctcccttccttctctctgggtccctgtgactggctttttgtttttttctgttgtccatcccaaaatcaagagaaacttccagccactgctgcccaccctcctgcaggggatgttgtgccccagacctgcctgcatggttccatccattactcatggcctcagcctcatcctggctccactggcctccagctgagagagggaaccagcctgcctcccagggcaagagctccagcctcccgtgtggccgcctccctggagctctgcccagctgtcagcttcccctgggcatcccagccctgggcattgtcttgtgtgcttcctgagggagtagggaaaggaaagggggaggcggctggggaaggggaaagagggaggaaggggaggggcctccatctctaatttcataataaacaaacactttattttgtaaagctgg

SEQ ID NO: 112820 - DNA, 1931 bp, Homo sapiens
  Payload ID: 2077
  Gene Symbol: CDH26
  Gene Name: cadherin 26
  Uniprot ID: Q8IXH8
  ENST ID: ENST00000244049
  CDS Start-End: 208-582
tggcaaggctaataagaaagcagcttttccaagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatggacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagtaaaagagttaggagcctttgaatgagtaagttctgattagattttatctttaaacaaaaccacaaaatttaattggtttttacttgtccacttactgctagtgtcagtttcaggggaagaaatggtttcttttaaaaatcttaataggggacatatgccctaaaaatagtcagttttctagtctgagtaatagataagagactgactaagcaaagtttaaaatgctatttggacactttaatgcacatattggatatctaaaagtctacagccatataaaaattttatataattaatgagcaaatgccgtctctcatgccctaaaataaatcagtagaaacatgtttgctggtgaatcagtgaagcattatgttaaacagtgagttacagctcagagttaaaactttctccttctttttgaagaagctgtgcaaatacttctttttaaggagatctggccttttcctacctggttacctcagtcttcctctgctttgggaagctgaaaaagaagaaaaatcacatttaaagcactggaatgtctgaatgggacgcttgaatgtgtagaacagctgtactgatcctagcatgactcagaggacagtctagggcattttctgggtaattcaggataaaagtatttttttttttaagaaaaatacatgtttttggacaacaaaacaaagtaaacattagtttattcgat

SEQ ID NO: 112821 - DNA, 2494 bp, Homo sapiens
  Payload ID: 2077
  Gene Symbol: CDH26
  Gene Name: cadherin 26
  Uniprot ID: Q8IXH8
  ENST ID: ENST00000350849
  CDS Start-End: 198-695
aataagaaagcagcttttccaagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatggacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgttacttacatttctatgattatgattctgcttccatttaagggaaaacttaggtaaatagagaaattttttctataacatttgtagtcagtatttgaagtgattttttaaaaaataagtattggtccctgttcactttttgattagataaatagataaaatatgttatcttgagaaaaatgattatgctgaaagctttataaacagtatactctttaaaaaatgaagagctgacataatttaacttgtatgtattatgtaagtaaaagagttaggagcctttgaatgagtaagttctgattagattttatctttaaacaaaaccacaaaatttaattggtttttacttgtccacttactgctagtgtcagtttcaggggaagaaatggtttcttttaaaaatcttaataggggacatatgccctaaaaatagtcagttttctagtctgagtaatagataagagactgactaagcaaagtttaaaatgctatttggacactttaatgcacatattggatatctaaaagtctacagccatataaaaattttatataattaatgagcaaatgccgtctctcatgccctaaaataaatcagtagaaacatgtttgctggtgaatcagtgaagcattatgttaaacagtgagttacagctcagagttaaaactttctccttctttttgaagaagctgtgcaaatacttctttttaaggagatctggccttttcctacctggttacctcagtcttcctctgctttgggaagctgaaaaagaagaaaaatcacatttaaagcactggaatgtctgaatgggacgcttgaatgtgtagaacagctgtactgatcctagcatgactcagaggacagtctagggcattttctgggtaattcaggataaaagtatttttttttttaagaaaaatacatgtttttggacaacaaaacaaagtaaacattagtttattcgattgcctccttatacttgcctctttcattctgtcccctgtagatttttaaaaaattatctcattttaaaactttattatttcattttaaataattgacatataataattgtacatatttagggggtacatagtcatgtttcaatacatttacagtgatcagatcagggtggttaacgtaatcattggctcaaacatttttcatttctttgtattggtacggagcattcaatatccatcccccttctagctatctaaaactatgtattattgttaactataggcaacatataatggtatagagtgctagaacgtattcctcctaggaataatttgctgtaattttgtatcctttaataaatctctccctatccctctttccccccacccttcccagctgctgtgtcctctgttctaccttctacttccgagataaacttggttttagcttcca

SEQ ID NO: 112822 - DNA, 3182 bp, Homo sapiens
  Payload ID: 2077
  Gene Symbol: CDH26
  Gene Name: cadherin 26
  Uniprot ID: Q8IXH8
  ENST ID: ENST00000348616
  CDS Start-End: 301-2799
agtcttttgtgtacgtgcaggaccatggtggctttagtttctaccccacccttcctaggaactctacttgtggcaaacgtatgttcaagcttacaagtcagcccaccccactctgataaatgcaagaaaagctgaaaagggaggagcaagatgggatgaaagcatctgggccaaagtgacctgaaaacctttagagaagaagctgctggctgagaaggaggtgtgtggctccggtgagaccaccagcttggaggactggtcatcagctgcacgttctgggtctgtcttgggtattcccatatggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcagaaactccatgttgccaatgtgctggaagatgaccccggctacctacctcacgtctacagcgaggaaggggagtgtggaggggccccatccctcagctctctggccagcttggaacaggagttgcaacctgatttgctggactctttgggttcaaaagcgactccgtttgaggaaatatattcagagtcaggtgttccttcctaaaaaaaaaagtctattttggagaattgaaataattcatggaagggaatcactattcagggatttttcccctttgctcttcttttccctccttaaaagaaaaattaccttctagtcctaggatgaggacacactattagtttgaattaaatgctttgatattctcagatcagccatcttgaaccaaagcaaaaccacaagttacactttcttaaaatttgatttgtcatattttctagagaaacttgaatttaattgtgttattcttagcttccactggcagcctagctttgagggtaaatgaaaatataacccatagattacccagccacttgggaacagcaggtaatactgaagaaaaataaaaatagattttgaaaacgtta

SEQ ID NO: 112823 - DNA, 1669 bp, Homo sapiens
  Payload ID: 2077
  Gene Symbol: CDH26
  Gene Name: cadherin 26
  ENST ID: ENST00000370991
  CDS Start-End: 1-1334
ccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcagtctaaagagagaaatcgcttcagcctcagcaggggctgcatcatcccccagggaagagccacagctgggcgaggattgccacaagacatttacaaggagatgatgccacggagactaacgcagactggtaaacggaaacacggggctttggctcgaacaccctctttcaagaaagttgtttatgaccacaaggaagatgaggagaacaaggctgggagaaagcaaaggagccacttgtttaaggttatgcagctgagaaatgaacaaggtggggttcgagtccagagtgcgcattccccatcaccccttaacaaaaaggcatgtttcccaggagactacagaggagaatcggcaggtggtcacaattgcagggctgtctcaggctgagcagagagtacggtggaggggcatgggcctgctgttggcggtgagggccttggaaatggcttcctggaggagatggcaattatccaggtagacaagatgtgtgtgtgtgtgtgtgtgtgtgtgtgtgtgatcatgaagaagaaataatgtgcaaagccctggtcataaataacttttcctctgcaaactgtggatggcagttcaccatgtttctcaccactggcctggtcactgcttatccaatatgcatgtaagaattactttttctcttttttcccttctataaattctcatagaacttcctttaatgcattaaaaaagcaactagcatgttc

SEQ ID NO: 112824 - DNA, 418 bp, Homo sapiens
  Payload ID: 2077
  Gene Symbol: CDH26
  Gene Name: cadherin 26
  ENST ID: ENST00000456106
  CDS Start-End: 178-418
aagaaacaatacaatattactggccagatagtattattgattaattcaacaaacagttatgtagcatctactggtaccctggaactgtgctgaactttatagctacacagatgactaagacgcaatttggccttgccagttcatgactgagttatacatgaacagaacaagatcctcatgaaacctctgatatggacatggtcagatgttgaaggccagaggccggctctgctcatctgcacagctgcagcaggacccacgcagggagttaagggttatggcaagccctttgagccaagaagtgtgaaaaacatacactctactcctgcttacccagatgccacaatgcacagacaactcctggctccggtggaaggaaggatggcagagacattgaatcagaaactccatgttgcca

SEQ ID NO: 112825 - DNA, 4929 bp, Homo sapiens
  Payload ID: 2078
  Gene Symbol: CDH3
  Gene Name: cadherin 3, type 1, P-cadherin (placental)
  Uniprot ID: P22223
  ENST ID: ENST00000264012
  CDS Start-End: 545-3034
ggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggtggcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttcccagaggtgcctggggagtgaactgttttctaaatagaaggtttattggcatctaactcacataccataccattcacttgtttaacgtttacaattcaatggtttttagaattttcagagttctgcaaaaagagtgggctctgtttaccctgctggcttcacccaagcttcctctcaatggcaggggatactcagggtcagcttccatgcctaagtgggctcagggaggggagacttgccctcctttgcaaagtcagttgctccatgagagagaaccattaacctcttaccccaaggctgagcccctccacagccccagcaaggtctcttctggaacagcggctgccctccctgcaggacagtgtgtgacgacttcctcttctatgctggaggggtccctgttgaaaggcaggggttggggaacagccagctctgctacttgctagcacatttttttttttttttttgagacggagtctcgttctgtcgcccaggctggagtgcagtggtgtgatcttggctcactgcaagctctgcctcctgggttcacgccattctcctgcctcagcctcccgagtagctgggactacaggtgcctgccactatgcccagctaattttttttgagtgtgtgtgtttttttagtagagacggggtttcactgtgttagccaggatgtctcgatctcctgacctcgtgatccgcccacgtcggcctcccaaagtgctaggattacaggcttgagccaccgcgcccagcgctggcacatcatttaacctccagttgcctcagattttacatttacaaaatggggagtttttgtggagattaagtgaattaatatctggcacatggtccatgcaatctgttagttggtaacagctaccatttattcagtacttttaaaggccagacaggacttcgattatttcctctaaatcctcacaatcaccctctgaggggactttctcctttaaagaatggccacattgtatttgtttttttaaatgacatctggtcatcatcgaaatcaagcaaaacaaaattaagagaacctacccaagatgtcagtgaaattggaacattcctgacaataccagggcataaatgcaggaatcaggaataggcagcagtgatagaacaattctgtttgtgcccttgttaacgtgaagttcaaagtcatctttgcaattagccaaaagaatctgaagtgaagctgaggaaattgctgatgttgaaataaacatttccttccatgagga

SEQ ID NO: 112826 - DNA, 3611 bp, Homo sapiens
  Payload ID: 2078
  Gene Symbol: CDH3
  Gene Name: cadherin 3, type 1, P-cadherin (placental)
  Uniprot ID: P22223
  ENST ID: ENST00000429102
  CDS Start-End: 388-2742
cttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgaggggaggggagagaggggctcacagagaggaaatggaggcttgcagctggcaagaggcaggacccgccgctcctaactacctgttctctgttgccgcagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggtggcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttccc

SEQ ID NO: 112827 - DNA, 573 bp, Homo sapiens
  Payload ID: 2078
  Gene Symbol: CDH3
  Gene Name: cadherin 3, type 1, P-cadherin (placental)
  ENST ID: ENST00000566808
  CDS Start-End: 1-221
tttgctggctgcagtgcgcggcctccgagccgtgccgggcggtcttcagggaggctgaagtgaccttggaggcgggaggcgcggagcaggagcccggccaggcgctggggaaaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatg

SEQ ID NO: 112828 - DNA, 892 bp, Homo sapiens
  Payload ID: 2078
  Gene Symbol: CDH3
  Gene Name: cadherin 3, type 1, P-cadherin (placental)
  ENST ID: ENST00000567674
  CDS Start-End: 1-125
ctgtgcgccaggtgctgaacatcacggacaaggacctgtctccccacacctcccctttccaggcccagctcacagatgactcagacatctactggacggcagaggtcaacgaggaaggtacctgagtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttccccctt

SEQ ID NO: 112829 - DNA, 570 bp, Homo sapiens
  Payload ID: 2078
  Gene Symbol: CDH3
  Gene Name: cadherin 3, type 1, P-cadherin (placental)
  ENST ID: ENST00000568292
  CDS Start-End: 1-467
atggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgaggtgaggcgtggcaggccagtcgagggccaccctttattcaagcccagcaccagccacacaggagaacaagcatgggcctggagtcttgggtctgggttcaaattctgactccaccaccaaccagcttttgacctctggcttatttgagtaacttctggggtttgtttcttcctccatagaactcacttgcagagtggttaaaaatgattag

SEQ ID NO: 112830 - DNA, 291 bp, Homo sapiens
  Payload ID: 2078
  Gene Symbol: CDH3
  Gene Name: cadherin 3, type 1, P-cadherin (placental)
  ENST ID: ENST00000569080
  CDS Start-End: 1-246
gtggttctccgcaatgacgtggcaccaaccatcatcccgacacccatgtaccgtcctcggccagccaacccagatgaaatcggcaactttataattgaggttttattgctctgcaggtctccaccctggcaggaagctcttgccaccggctacagtctggatccagcctggccagttccacctttcccacctacaacacctggcaagaccaagacacagcccttccacaaatacatgagtacatgagcacgtggggtggacaagccatccaatcagtcctcactgactctg

SEQ ID NO: 112831 - DNA, 2746 bp, Homo sapiens
  Payload ID: 2078
  Gene Symbol: CDH3
  Gene Name: cadherin 3, type 1, P-cadherin (placental)
  ENST ID: ENST00000542274
  CDS Start-End: 80-226
gcggtgctcaaaggggcaagagctgagcggaacaccggcccgccgtcgcggcagctgcttcacccctctctctgcagccatggggctccctcgtggacctctcgcgtctctcctccttctccagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggtggcttccttagcctttcaggatggaggaatgtgggcagtttgacttcagcactgaaaacctctccacctgggccagggttgcctcagaggccaagtttccagaagcctcttacctgccgtaaaatgctcaaccctgtgt

SEQ ID NO: 112832 - DNA, 563 bp, Homo sapiens
  Payload ID: 2078
  Gene Symbol: CDH3
  Gene Name: cadherin 3, type 1, P-cadherin (placental)
  ENST ID: ENST00000569036
  CDS Start-End: 1-179
gactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggc

SEQ ID NO: 112833 - DNA, 3117 bp, Homo sapiens
  Payload ID: 2079
  Gene Symbol: CDH4
  Gene Name: cadherin 4, type 1, R-cadherin (retinal)
  Uniprot ID: P55283
  ENST ID: ENST00000543233
  CDS Start-End: 283-2811
gcactggcgctctggctttcttctttctccctctgccttaatgatgctgcccctttcctgttcctggttgaagctgaagcccgcttcccttcgccgcacacaacacaggagcaatcttctcagccgtgcactcacagcttggaaaataaagggaggaaggagtcccagccacagggtagaggaacggcctctccacagagaagctgctgctgctgagctgaagtgacagtcaagttcagcagctgtgtggggaccaaggggacacaatatgagaccaacagcatggacttcaaagttggggcagatgggacagtcttcgccacccgggagctgcaggtcccctccgagcaggtggcgttcacggtgactgcatgggacagccagacagcagagaaatgggacgccgtggtgcggttgctggtggcccagacctcgtccccgcactctggacacaagccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaagcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaaaaaaaaaaaaaagaagaaagaaag

SEQ ID NO: 112834 - DNA, 3304 bp, Homo sapiens
  Payload ID: 2079
  Gene Symbol: CDH4
  Gene Name: cadherin 4, type 1, R-cadherin (retinal)
  ENST ID: ENST00000611855
  CDS Start-End: 561-3029
atcttgggcctgtcacttggggagcactgtagaaggttctggagaaggcattgagactataattctactttaatgagctgggctacctagattctatggtacagcaagagaagctgtttgtatgcacctgtatgtacgtgccttacttaaaattcagaaagaaaatcttcaggtgccagaattacttgtgaggctggtgaagagtgaaaagccacttcccaggccagacaggaaagagtgccctggttgggaccagacgggcctggctgcagacgtacactttgggcttcagcagccctggtgctgccttgagcttgacccgaattgcttcttcccagaggctgggtctccctcgcagcccctgctctcaaggatgggaatgagaaggtcgatgacaaggcacctctgctttacatccaagcgttgacttttgtggcttcctttaccccattgctctgccctttaaagggtcctggtgtgtttgggaatgggacagacaattttgtttttcacaatggtattgggctgtggatccagaactcaagttccagaggaaagcgatgccaaagtcaacagggatgcttcacggaggcagggaaaatgcaggagtcaagttcagcagctgtgtggggaccaaggggacacaatatgagaccaacagcatggacttcaaaccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaagcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgttttt

SEQ ID NO: 112835 - DNA, 6513 bp, Homo sapiens
  Payload ID: 2079
  Gene Symbol: CDH4
  Gene Name: cadherin 4, type 1, R-cadherin (retinal)
  Uniprot ID: P55283
  ENST ID: ENST00000614565
  CDS Start-End: 89-2839
agcggcggcggtggtctcggcggcggcggcggcggcggcggcagggagcgggctcccggtgccgggcaccgggcgggcggcggggaagatgaccgcgggcgccggcgtgctccttctgctgctctcgctctccggcgcgctccgggcccataatgaggatcttacaactagagagacctgcaaggctgggttctctgaagatgattacacggcattaatctcccaaaatattctagaaggggaaaagctacttcaagtcaagttcagcagctgtgtggggaccaaggggacacaatatgagaccaacagcatggacttcaaagttggggcagatgggacagtcttcgccacccgggagctgcaggtcccctccgagcaggtggcgttcacggtgactgcatgggacagccagacagcagagaaatgggacgccgtggtgcggttgctggtggcccagacctcgtccccgcactctggacacaagccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaagcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaaaaaaaaaaaaaagaagaaagaaagaaaaaaaaaaaaaaaagaaagtgccttttggtacatgtatcagattccctcaaactcaggagtgtctaaagcagacagaccgtccccaccttcccatcccgagcggcctccaaccccagctagtcccagctctgaaggcatcattcagaaatgggggagactgtgtctgtctttcttactttttttttggtcttttattaagaaaaagaaagtgggtgacttgtttgaaaacagagtggggttcaaatcccagcagcctttgctgtacacagctgggggtctcttgagcctcttgggagtcaaggccagctgggaggcttagcccttcagccccagcagaaggccctggggctggtggggctcagaatacccctaccttgtggctgctccccacccctcccggatgctgtgaggagctcaggcaggggcctggaggggaacaggggtcatcctgaaggggctccacccccagtcaacccaggcctccctcagggacacctgtcaccctgagtgccaccaggtcccctctgcctttggtccagaagagtgagttgtccaaaccagccagcatctggctccagccctccaaccctggcgaccagaccccatggggtgccatcaacggccccgcgacaggcatcaattcaaaccccaggacactctcgacagctccaaccatccggagggctgtgcagatggcaggaaccaaggaccctccctggcagctgaagagggcagttacggttgggcgtggtgaccagaacacacccagcagcctgcgaagcctccccgtccccagcctgtgctcctgattcccgccagacgcttgtgagcctgtgtgggtggcaggaggccccgtcttgccgtgcctacctgtcgcacagatgcctctgcacgctgcagacggtgcctctcctctcctatggaccctcgtcgggggcaggcagcggccgggtccaaacttgctgctgtcctcgaggctggcactgctatctccagggctgggttgactcaagccagacagggggaaggaattggttctgcaggacagtgagagggtctgtgtcccggcacccctgggacagcgctcggctgcctgtgctcactgcatgagaaaactcagagggtgcattctccctctggcatggctgtgtctgggcgccttgggctgcggcagggggcaggccccacgtggggaagcctcgtgcttggtcagctttctgtctctcccaggccagtgacaactggcttcccgaggaaggaggtgaggtaccagggaccctgggcaggacctggtgtcgggcagggcggtgccagcactggggaaggacagggagccctcccggagccccaccctgcacctgccactggggtcagggagtgtctcggggtgcctttgggggcagcatgagctccaccaggggccccggcccccacctcagcctatggcccttccccatggctaaggtcatgccttttctgaacagctttggccttgagtgcacacatctgtgccaggctcacggcatgttcccgttggatgtcagggtccttgtccaaaccaaactcacagctgcccctgtgcagccttcagagttgagctggggtctcagtctccaacctgtcctttctgaccctcccatggctgcccagggagggcggggttcactgtgccacgtgctgggtgcccccctctgcagacagccagtccaggagatggaccaacagaggtcaaggggcagctggccaggccgcaccggggtccccgagttctgagctgtgctatgcaaacaagaatgctcctgtgtgggggggcatggccgttggaggtatagctgggcgggtagtggaaggactggaaatctctgttgttgtttggggaagtccatgcttcagtccttcggagtatgcgtggattgttcgaagtgtgactatggcccgggagccagggcagcatgaactcctttctctgaaatttcgaggcctccttgggttccctgaactccgggctgatgttcccaggacccagcaccaggagaccccagtcccgccagcagccgccgctacccaggagggctgggcgacattggccgcctcccactagctccccctcctcgcccacagcctcttgtcactgccaagcccccgttccttttgcccaaatcacgcaggcggaagctgcagtgccagctggagggatgttcatagggcttcctgtgcccatccctgctccaaacagctggacagcttcccctctacccccaccctggtgagcccctgggggccagagaaagatggggttcctgcaccttcccagctccacctctgaacttgagttagcgttagctaagcatacaatcagtgtcgaacgtctctcttccttaagcttgtagatacgactgcctataatcaggggactcccactggaggccgggaggccaatgctggccaggtgcgagggcatggtttggttcctttagggaatttttgttttgcaaacaggagaaacctgtgctgcaggttggagtggcaggaacgactggccttggtcagcaggcagcccccagcctagggccacagtcctcttcagggcctgggcagccccaatttctggcccagcaggtttctctttgtagtgtctttcagcacatccaaaatgctaggcctcctgccaccaacgtgtcagagcaatgtccaactgtcaggctctcagagatgcctcagtttccctagcatgagcaccagccgacacacacagtccactgagatgataattctgttctctccaaagcaaaaagctgggcgaggggtagtctcaatttctgtcagtgctcaaaggaataacaccaaaagaatcaacacagaatctcccagacacacgtgacccagctcgtggcgccgtgggtccgtaggagggacagtacctcacaacaggcccagcgggggaccacctctctgtacaattggaatgcgttttacttttcttttctctccttttttcattccgattttttttgcatgtttctttttgaaatgggcaaaatgtgtagcagcctgcatgagcacagttgttttggggaaagatactggagtatgatgtactcacacctgcaaatctgagcatcgcgaggttaaacgttccacctttttttgtaatcgtcaacagcacaactattttgtattgttgtttgtatcattttgtaccaaaaaaaaaaaggaaaaaaaaagggaagagagttgatgttttcagtgtgtttccagtgccagacagtcttggtcctgaactcagtagacccttgcggagcggttgtgcgcgggcaggcggggcgcgctgctccagagaatgaataaagtcccccttttccgta

SEQ ID NO: 112836 - DNA, 5377 bp, Homo sapiens
  Payload ID: 2079
  Gene Symbol: CDH4
  Gene Name: cadherin 4, type 1, R-cadherin (retinal)
  ENST ID: ENST00000625686
  CDS Start-End: 1-1701
aaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaggcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggtgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaaaaaaaaaaaaaaagaagaaagaaagaaaaaaaaaaaaaaaagaaagtgccttttggtacatgtatcagattccctcaaactcaggagtgtctaaagcagacagaccgtccccaccttcccatcccgagcggcctccaaccccagctagtcccagctctgaaggcatcattcagaaatgggggagactgtgtctgtctttcttactttttttttggtcttttattaagaaaaagaaagtgggtgacttgtttgaaaacagagtggggttcaaatcccagcagcctttgctgtacacagctgggggtctcttgagcctcttgggagtcaaggccagctgggaggcttagcccttcagccccagcagaaggccctggggctggtggggctcagaatacccctaccttgtggctgctccccaccccctcccggatgctgtgaggagctcaggcaggggcctggaggggaacaggggtcatcctgaaggggctccacccccagtcaacccaggcctccctcagggacacctgtcaccctgagtgccaccaggtcccctctgcctttggtccagaagagtgagttgtccaaaccagccagcatctggctccagccctccaaccctggcgaccagaccccatggggtgccatcaacggccccgcgacaggcatcaattcaaaccccaggacactctcgacagctccaaccatccggagggctgtgcagatggcaggaaccaaggaccctccctggcagctgaagagggcagttacggttgggcgtggtgaccagaacacacccagcagcctgcgaagcctccccgtccccagcctgtgctcctgattcccgccagacgcttgtgagcctgtgtgggtggcaggaggccccgtcttgccgtgcctacctgtcgcacaggtgcctctgcacgctgcagacggtgcctctcctctcctatggaccctcgtcgggggcaggcagcggccgggtccaaacttgctgctgtcctcgaggctggcactgctatctccagggctgggttgactcaagccagacagggggaaggaattggttctgcaggacagtgagagggtctgtgtcccggcacccctgggacagcgctcggctgcctgtgctcactgcatgagaaaactcagagggtgcattctccctctggcatggctgtgtctgggcgccttgggctgcggcagggggcaggccccacgtggggaagcctcgtgcttggtcagctttctgtctctcccaggccagtgacaactggcttcccgaggaaggaggtgaggtaccagggaccctgggcaggacctggtgtcgggcagggcggtgccagcactggggaaggacagggagccctcccggagccccaccctgcacctgccactggggtcagggagtgtctcggggtgcctttgggggcagcatgagctccaccaggggccccggcccccacctcagcctatggcccttccccatggctaaggtcatgccttttctgaacagctttggccttgagtgcacacatctgtgccaggctcacggcatgttcccgttggatgtcagggtccttgtccaaaccaaactcacagctgcccctgtgcagccttcagagttgagctggggtctcagtctccaacctgtcctttctgaccctcccatggctgcccagggagggcggggttcactgtgccacgtgctgggtgcccccctctgcagacagccagtccaggagatggaccaacagaggtcaaggggcagctggccaggccgcaccggggtccccgagttctgagctgtgctatgcaaacaagaatgctcctgtgtgggggggcatggccgttggaggtatagctgggcgggtagtggaaggactggaaatctctgttgttgtttggggaagtccatgcttcagtccttcggagtatgcgtggattgttcgaagtgtgactatggcccgggagccagggcagcatgaactcctttctctgaaatttcgaggcctccttgggttccctgaactccgggctgatgttcccaggacccagcaccaggagaccccagtcccgccagcagccgccgctacccaggagggctgggcgacattggccgcctcccactagctccccctcctcgcccacagcctcttgtcactgccaagcccccgttccttttgcccaaatcacgcaggcggaagctgcagtgccagctggagggatgttcatagggcttcctgtgcccatccctgctccaaacagctggacagcttcccctctacccccaccctggtgagcccctgggggccagagaaagatggggttcctgcaccttcccagctccacctctgaacttgagttagcgttagctaagcatacaatcagtgtcgaacgtctctcttccttaagcttgtagatacgactgcctataatcaggggactcccactggaggccgggaggccaatgctggccaggtgcgagggcatggtttggttcctttagggaatttttgttttgcaaacaggagaaacctgtgctgcaggttggagtggcaggaacgactggccttggtcagcaggcagcccccagcctagggccacagtcctcttcagggcctgggcagccccaatttctggcccagcaggtttctctttgtagtgtctttcagcacatccaaaatgctaggcctcctgccaccaacgtgtcagagcaatgtccaactgtcaggctctcagagatgcctcagtttccctagcatgagcaccagccgacacacacagtccactgagatgataattctgttctctccaaagcaaaaagctgggcgaggggtagtctcaatttctgtcagtgctcaaaggaataacaccaaaagaatcaacacagaatctcccagacacacgtgacccagctcgtggcgccgtgggtccgtaggagggacagtacctcacaacaggcccagcgggggaccacctctctgtacaattggaatgcgttttacttttcttttctctccttttttcattccgattttttttgcatgtttctttttgaaatgggcaaaatgtgtagcagcctgcatgagcacagttgttttggggaaagatactggagtatgatgtactcacacctgcaaatctgagcatcgcgaggttaaacgttccacctttttttgtaatcgtcaacagcacaactattttgtattgttgtttgtatcattttgtaccaaaaaaaaaaaggaaaaaaaaagggaagagagttgatgttttcagtgtgtttccagtgccagacagtcttggtcctgaactcagtagacccttgcggagcggttgtgcgcgggcaggcggggcgcgctgctccagagaatgaataaagtcccccttttccgta

SEQ ID NO: 112837 - DNA, 1976 bp, Homo sapiens
  Payload ID: 2079
  Gene Symbol: CDH4
  Gene Name: cadherin 4, type 1, R-cadherin (retinal)
  ENST ID: ENST00000629889
  CDS Start-End: 1-1701
aaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaggcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggtgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgttttt

SEQ ID NO: 112838 - DNA, 2008 bp, Homo sapiens
  Payload ID: 2079
  Gene Symbol: CDH4
  Gene Name: cadherin 4, type 1, R-cadherin (retinal)
  ENST ID: ENST00000628489
  CDS Start-End: 1-1701
aaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaggcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggtgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaaaaaaaaaaaaaaagaagaaagaaag

SEQ ID NO: 112839 - DNA, 4120 bp, Homo sapiens
  Payload ID: 2080
  Gene Symbol: CDH5
  Gene Name: cadherin 5, type 2 (vascular endothelium)
  Uniprot ID: P33151
  ENST ID: ENST00000341529
  CDS Start-End: 149-2503
ctcgccagcggggtgtggctcccctccaaagacggtcggctgacaggctccacagagctccactcacgctcagccctggacggacaggcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggcgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcatcttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaaca

SEQ ID NO: 112840 - DNA, 615 bp, Homo sapiens
  Payload ID: 2080
  Gene Symbol: CDH5
  Gene Name: cadherin 5, type 2 (vascular endothelium)
  ENST ID: ENST00000562048
  CDS Start-End: 222-615
attttgcagcacatgactctatttatccatctgaccgctggctgcggtcagccctagggatcactaacccatcccaataggccccaggaaagagaaaaccacattcccgctcactgtattagagatggggttcccagcaggaaacagagcgaaccctgggaggccaattgaagagattttatgaagggactgcttcagagagatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggcgaaaacctgg

SEQ ID NO: 112841 - DNA, 591 bp, Homo sapiens
  Payload ID: 2080
  Gene Symbol: CDH5
  Gene Name: cadherin 5, type 2 (vascular endothelium)
  ENST ID: ENST00000568023
  CDS Start-End: 540-591
cctgcctcctttcttctccaagcctttcctcaccgccttcctcctgcctagagcatcccttcaagggcctcaagtctcttccaggttgaccccctcatttatggctgaggaaactgaggcccagaggggtcagggcctctcccaggcatatggcacttgcattctggggcctatccccaccctgggagtccacttcctccagggccagaggcaggaaccagaaggcaggggccgtcgatactaaaatcagtgggcccagaggtcagctggcccagcacagacaccctcagccctccctgaggtcagcctggcgccagcaaatcaggggaaatgttactagagtttacaaacctcttgtgatgtacagagtccagcctctccctctggccagacaggggacagtcaagggaggaggccatcccatccagcaccttgtagatccttgtctgtctccatatgtgagtcctggttccctctcccacccacctgttcttcctctacatcatcccaggagttgcagatctgttcctcctgggaagatgcagaggctcatgatgctcctcgccacatcgggcgcctgcctgggcctgc

SEQ ID NO: 112842 - DNA, 2138 bp, Homo sapiens
  Payload ID: 2080
  Gene Symbol: CDH5
  Gene Name: cadherin 5, type 2 (vascular endothelium)
  ENST ID: ENST00000565334
  CDS Start-End: 89-421
cactcacgctcagccctggacggacaggcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcatcttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtct

SEQ ID NO: 112843 - DNA, 459 bp, Homo sapiens
  Payload ID: 2080
  Gene Symbol: CDH5
  Gene Name: cadherin 5, type 2 (vascular endothelium)
  ENST ID: ENST00000568155
  CDS Start-End: 231-459
agccctagggatcactaacccatcccaataggccccaggaaagagaaaaccacattcccgctcactgtattagagatggggttcccagcaggaaacagagcgaaccctgggaggccaattgaagagattttatgaagggactgcttcagagaggtgggctcctttaaggaaaccaaccactgcctgcacagaggtgggctcggatgttgagatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtc

SEQ ID NO: 112844 - DNA, 1932 bp, Homo sapiens
  Payload ID: 2080
  Gene Symbol: CDH5
  Gene Name: cadherin 5, type 2 (vascular endothelium)
  ENST ID: ENST00000563425
  CDS Start-End: 114-1334
attatatctagctgctcttatgtgaaatacctgtgtctaagtactcctttcatcgtcactggccagagtctgaatgtgtctcctctttccccagatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggcgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattgggtaagggggcgtgtgtcgatgagaatgataaggacaatccggcctggatgttcctatgcctgctggtctgaggccaggactcagagaggggaactggcttctcctagcacttacagggaaagtgacagaggcaagaccagaagcccaagctcttgcacttggcagcctggcatcttgacctgcctggactcccccacctagcatggtcctgggcatccagagctacttgtcctctgtccggccttgaaggcttattctctgcaccacagctctcaccagtcctatgtggtaagatctgacagtcaagaaagcaaccaatcagacgacacaccagaggccccttcactaaaactgtattcttgaatctatcttccccaaaccacaaaagtaagaagtgttcattttatacagtgaaacaacacagagatctaccaagaaaacactgataacccccactctcagataactcatgttcgtggcctaacctggtcctattgctcctttcttttcgtgaccacacaaacatgtggatgcatttatggtgggtttgttgttgtctgtttgcttttgatgtttgattgttttaaaatttttttggatca

SEQ ID NO: 112845 - DNA, 1672 bp, Homo sapiens
  Payload ID: 2080
  Gene Symbol: CDH5
  Gene Name: cadherin 5, type 2 (vascular endothelium)
  ENST ID: ENST00000539168
  CDS Start-End: 835-1506
ataatgtgtagactcaagcctttcttcagatcaggaaacttttcttttctttttttttttttttttttttgttatttcttctgttctgtttgttctgggattttcctcattaatagcaactattattcctatatacacaaaacatatatatttatctttccatagatttttcctgatttctgaaagaactttttaagttttttatttcacaaagttaatttctttgtaattacttcttatctcttccagctctttttgtattccttcctggctcttgcccaatgatcttttcattaatcactaaaacaagtcccagctatggtgtgatgtcacctgttcagctctgaaagtgcatctgatggtctcagatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcatcttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttc

SEQ ID NO: 112846 - DNA, 3779 bp, Homo sapiens
  Payload ID: 2080
  Gene Symbol: CDH5
  Gene Name: cadherin 5, type 2 (vascular endothelium)
  Uniprot ID: P33151
  ENST ID: ENST00000614547
  CDS Start-End: 157-2166
aggcctccctcgccagcggggtgtggctcccctccaaagacggtcggctgacaggctccacagagctccactcacgctcagccctggacggacaggcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggcgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctggtcctgcagatctccgcaatagacaaggacataacaccacgaaacgtgaagttcaaattcatcttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggc

SEQ ID NO: 112847 - DNA, 8476 bp, Homo sapiens
  Payload ID: 2081
  Gene Symbol: CDH6
  Gene Name: cadherin 6, type 2, K-cadherin (fetal kidney)
  Uniprot ID: P55285
  ENST ID: ENST00000265071
  CDS Start-End: 266-2638
ttcgcatcccaagagctgcagtttcagccgcgacagcaagaacggcagagccggcgaccgcggcggcggcggcggcggaggcaggagcagcctgggcgggtcgcagggtctccgcgggcgcaggaaggcgagcagagatatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaagttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcggtacatttgttgtccaagtcactgcgacggatgcagatgatccaacatatgggaacagtgctaaagttgtctacagtattctacagggacagccctatttttcagttgaatcagaaacaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagttgattcagaccctgcatgctgttgacaaggatgacccttatagtggacaccaattttcgttttccttggcccctgaagcagccagtggctcaaactttaccattcaagacaacaaagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccatgcggaggcgctcatccaccccacgggactgagcacgggggctctggttgccatccttctgtgcatcgtgatcctactagtgacagtggtgctgtttgcagctctgaggcggcagcgaaaaaaagagcctttgatcatttccaaagaggacatcagagataacattgtcagttacaacgacgaaggtggtggagaggaggacacccaggcttttgatatcggcaccctgaggaatcctgaagccatagaggacaacaaattacgaagggacattgtgcccgaagcccttttcctaccccgacggactccaacagctcgcgacaacaccgatgtcagagatttcattaaccaaaggttaaaggaaaatgacacggaccccactgccccgccatacgactccttggccacttacgcctatgaaggcactggctccgtggcggattccctgagctcgctggagtcagtgaccacggatgcagatcaagactatgattaccttagtgactggggacctcgattcaaaaagcttgcagatatgtatggaggagtggacagtgacaaagactcctaatctgttgcctttttcattttccaatacgacactgaaatatgtgaagtggctatttctttatatttatccactactccgtgaaggcttctctgttctacccgttccaaaagccaatggctgcagtccgtgtggatccaatgttagagacttttttctagtacacttttatgagcttccaaggggcaaatttttattttttagtgcatccagttaaccaagtcagcccaacaggcaggtgccggaggggaggacagggaacagtatttccacttgttctcagggcagcgtgcccgcttccgctgtcctggtgttttactacactccatgtcaggtcagccaactgccctaactgtacatttcacaggctaatgggataaaggactgtgctttaaagataaaaatatcatcatagtaaaagaaatgagggcatatcggctcacaaagagataaactacataggggtgtttatttgtgtcacaaagaatttaaaataacacttgcccatgctatttgttcttcaagaactttctctgccatcaactactattcaaaacctcaaatccacccatatgttaaaattctcattactcttaaggaatagaagcaaattaaacggtaacatccaaaagcaaccacaaacctagtacgacttcattccttccactaactcatagtttgttatatcctagactagacatgcgaaagtttgcctttgtaccatataaagggggagggaaatagctaataatgttaaccaaggaaatatattttaccatacatttaaagttttggccaccacatgtatcacgggtcacttgaaattctttcagctatcagtaggctaatgtcaaaattgtttaaaaattcttgaaagaattttcctgagacaaattttaacttcttgtctatagttgtcagtattattctactatactgtacatgaaagtagcagtgtgaagtacaataattcatattcttcatatccttcttacacgactaagttgaattagtaaagttagattaaataaaacttaaatctcactctaggagttcagtggagaggttagagccagccacacttgaacctaataccctgcccttgacatctggaaacctctacatatttatataacgtgatacatttggataaacaacattgagattatgatgaaaacctacatattccatgtttggaagacccttggaagaggaaaattggattcccttaaacaaaagtgtttaagattgtaattaaaatgatagttgattttcaaaagcattaattttttttcattgtttttaactttgctttcatgaccatcctgccatccttgactttgaactaatgataaagtaatgatctcaaactatgacagaaaagtaatgtaaaatccatccaatctattatttctctaattatgcaattagcctcatagttattatccagaggacccaactgaactgaactaatccttctggcagattcaaatcgtttatttcacacgctgttctaatggcacttatcattagaatcttaccttgtgcagtcatcagaaattccagcgtactataatgaaaacatccttgttttgaaaacctaaaagacaggctctgtatatatatatacttaagaatatgctgacttcacttattagtcttagggatttattttcaattaatattaattttctacaaataattttagtgtcatttccatttggggatattgtcatatcagcacatattttctgtttggaaacacactgttgtttagttaagttttaaataggtgtattacccaagaagtaaagatggaaacgttaaaagaagagaaatgtagtattttgggttacctgattagagtgaaaattttttacaatcatattattccttgtgtcttctgaatggtttccgattttataatggactgccctatatagtaacaagtatttcatgcttgagctatttcctgctttcagggtttcttttttctagttcttcatacacacacatacacacacacacacacacacacacacacacacacgaatgcaaacaaaaggctatatgaggtcttcactctaatgaattgatatgtatcatagtcacaggtaagtgttgaaaaaagcttagtaaagttagaagctacttactcatagcaatagaacagcaccttaatcacacgatttactgtaaaattaaagaggtctctatctgtatgtttcatgtcacgtaacaaattgaatcaaggaagatagtcctgtaaaaagaaaggtatcatctgaagttgaggattgacactagcagtttccaatgtttaaaggtaagatctgagttctcctaataagtaaaagtaagtagttctatagcagaatatctgagatgtaattggcaaggtattttatccctccctgcagatgacacagcataccaagaacaggttaatatgattacttatggaaataactttaatctcttatcataaaagctgatgatgaagtaaatttataggaaattggataatttgagactggggctaaatatttagtaccagggtactgtaagtatcaagttggagtgacgttttcctataattcagactctttgacatcgtggaaccaataagagtcatagttccatcattctccagcttcgtctcacttccttcccaccccacctgagtatcaggtcaaacatcattgcatgcgcaggttttttttttaattgctaggtcccaggcaacatgaaagattattggagaaaaaaataattttcagcccagttttttcattgtctgtttcctaattttagatgttggtgatgggaaagatggaaggagagtgggaagaagtaaaattttaatatttgtttcaatcactttgaaactaaaattcattaagcataaccagattgcttttgtgggttgtttcaaggacattgagagctttctgatgatatgtttttgccctctattcaaaagcaagagttcctttaaactactaagatattccctagaataagctgaatttaaaaaaacattaagccattgtttaaagccccttcacttcctggccacttacttctgaaaggcctaaaaaacatttgtgcccaaataagtaaataaaccaaatgggaaagaagcaaagattattccatagaaccacaagagagggaatgtgggcacagtaaatagatgtttctttcagaactttcctgcctttacagtttgtgtccataaagggatgttcagcaatgaaattactcccttttcagatggaacaaaacctgcccatttaattttaacgcagtataaaaaacgtgtggtttagtttttattttcagctcccaaagagttgtgcagaaaatcttaaaattttttttttttttttttttttttttttgagacagaatctcgctctgtcgcccaggctggaatgcagtggcgcgatctctgctcactacaagctccgcctcccgggttcacgccattctcctgcctcagcgcccccagtagctgggactacaggcacacaccaccacgcccggctaatttttgttgtattttttagtggagacagggtttcaccatgttagccaggatgatctccatctcctgacctcgtggtccgcccgcctcggcctcccaaagtgctgggattacaggcgtgagccaccgcgcccggccttaaaaattgaatctgtagcttaggccatccaaattttataaatccaaattaactttagaatgtttctattactttcacttttacatatataaattttaagtgtcctgattggctgaacaatatctcacatcaaatgctttgcctggaaatagatatcccactggggatagtggtgtgtaaactatgacttggacaattctatatactcaagcaccataaaaagtatgcagttgaaaagaaaatcaaagttgattcctgggtgccaactaaatattcaaatcaggtactcatccttatcagctaaattcattttcaccaggaacagaccaccaaataaattattttatcctaataactagttttgaagcagtgtaattactctggaagaaggctctaaaaagtcatgattcccccactattttgaaatgtatcctctaacaaggatcattatagtgtaatcttaatttttatgttttatcaagatgaaatcttgtttgaattgtgatattataaaaggggactcaaaaatccaagcagtctactgtgtttaaattaacaccacaaccttccttatcagattataagagtagaaaaattaacacttggtgtgtgaatcttcaggaaaatgagctatttcataagctcaaacaagcagcttccttttccagagaatatagaattatattatggtctccttaaatgtttagtagctcttatggtcacagcatttttaatctccctatggcatctttatggaataattttctaaagggtaattctctactaaaaatatcagaccccgaccatatttaatgtggagagcaataccctcttagaaagaaaatacattgactcatacacttgttaaaagttaataaagaaatagctcatttttaaagccggaagtttatggtctctgcatcgtcaatttaatttaagcattgctgagacaatctttaatctactcccctttttgtaataccttatttatggtgcattttcatttttatttgggggaaacgttagcccaacagagccggcagatgaaagtgttgaaaagaggtcaaatggaaacaaaggctcttacccgctgtatttcagacaggactgaggcacttagccgaggagccactgggttattagattaatttcaaaagagcttttacaagttgcttaattcctttttttttttttttttttttcaaaaacccatgaaccacaaactcaaatttctcctcaaatggggttaatctgacaaacgaggcatggacccagccttgtggaaaaagcattccacgctaatgagatcttggtctttcttgtgaggctacgttatttatgtaaatatgtctggaggcaccttctctaagcttttagttttctatgatctattagtttagtgtttattaaagaatcaaatgtatagaattaccaggcattcgtggggaatgctgtgtagcaaatgtaaaactgacctgctcggaagaaacgtaggaacgcttcaaacccactgtaatgtttggtttgagattattttcattgctttgagagtgaactgcctaagagtaggccttataataaatgctatgtgcgtcttcagtagttccaagctaaagcaatttggcattctcccactgtgatttgtgacttttaaacccacaaaataaaagctttttggtattgattgtttttaattaaaaatacttccaagtataaattgaaacggatgccacccttgaagatttactggcgggaatgctcactcttgtcgttttcctcagtatcgttcatgtctttggcaacaagaacacctgatgaaagcaagcaatgctcagttcccatcaacatttctagttagggggattctcataaccccacagtttacctgagaaagttttctgtgttagaagaatggggtcgagagtattaccttttagctcagtgtggccgggccttttgttgcagtcaaatggcaaatacgcactccttgaaatggcttcttttatttggttttgttttcttagacttataaatttgaaaagaatgcaatttaaaaagtgatttctcacaaagagtaaatatgccttttgcaaatcaatttttgtaacaagttatttatatgatattacttaataaactggtttttttctaa

SEQ ID NO: 112848 - DNA, 2569 bp, Homo sapiens
  Payload ID: 2081
  Gene Symbol: CDH6
  Gene Name: cadherin 6, type 2, K-cadherin (fetal kidney)
  ENST ID: ENST00000514738
  CDS Start-End: 431-2257
ttcgcatcccaagagctgcagtttcagccgcgacagcaagaacggcagagccggcgaccgcggcggcggcggcggcggaggcaggagcagcctgggcgggtcgcagggtctccgcgggcgcaggaaggcgagcagagatatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaagttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcggtacatttgttgtccaagtcactgcgacggatgcagatgatccaacatatgggaacagtgctaaagttgtctacagtattctacagggacagccctatttttcagttgaatcagaaacaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagttgattcagaccctgcatgctgttgacaaggatgacccttatagtggacaccaattttcgttttccttggcccctgaagcagccagtggctcaaactttaccattcaagacaacaaagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccatgcggaggcgctcatccaccccacgggactgagcacgggggctctggttgccatccttctgtgcatcgtgatcctactaggtaaactggttctccctgcctcctatctccccatggtgaggggctcacactgttactgtgacactctagatttatctgcctcccccattaaggcatacagcctgatctaggtgagtcgagttacatactgagaatctgtgctgtacgatgtgaactcatttttgcttgcaaatggctttggaaaatgaacagatgtgaaacttgctcgtgtctttgcttgcccaggaagcaaagaatctcttgtctatcagactgggaatgaatctcgggggatttcagggcaacataaatgtgcccttttcatttcattcgttgtgtaatttttttacttggaaaacgttgttaagtgtctggcatggagtgtatgatgagggccctttctataaaggtaaagtttaaagatctatgggaaagtgggaaga

SEQ ID NO: 112849 - DNA, 2728 bp, Homo sapiens
  Payload ID: 2082
  Gene Symbol: CDH7
  Gene Name: cadherin 7, type 2
  Uniprot ID: Q9ULB5
  ENST ID: ENST00000323011
  CDS Start-End: 326-2683
ctagggcagtccgaggagattgaaagggcaaaactatcaagcaagaaaactgtaagttctgattagttttatgactttgccttcatgcctcaggagctcaactgatcacggctttcacgacaggctaaggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgtcattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccaacaccctcaccatccgcgtgtgtgactgtgatgctgacggcgtagcccagacctgcaatgcagaggcctatgtcctacctgctggcctcagtacaggagccctgatagccatactcgcctgtgtcttgacattattggtgttgatcctccttatcgtcactatgagaagacggaaaaaagagccccttatttttgacgaagaaagagacatcagagaaaatattgtgagatacgatgacgagggcgggggagaggaggacacggaagcgtttgacatggctgcactgagaaacctcaacgtcatccgagacaccaagacccggagggatgtgactccagaaattcaattcctgagtcgaccagcttttaaaagcatcccagataatgtcatctttagggaatttatttgggaaagattaaaagaagccgatgttgatcctggtgctcctccttatgactccctgcagacatatgcttttgaaggaaatggctcagttgctgaatcactcagctctttagattccatcagctcaaactctgatcagaactatgactacctaagtgactggggacctcgctttaaacgactcgcggacatgtatgggactggccaagagagtttgtactcatagccttggaaccttaattcgaaatgtactgaagaaaaagtaacagca

SEQ ID NO: 112850 - DNA, 12231 bp, Homo sapiens
  Payload ID: 2082
  Gene Symbol: CDH7
  Gene Name: cadherin 7, type 2
  Uniprot ID: Q9ULB5
  ENST ID: ENST00000397968
  CDS Start-End: 427-2784
gggcagggtccccgcgcaccgcggagtgggctgtgattggaggaggagcccgtgccgggcgggcccgagcgggtgtcgagccggttcctccagtctgccccgcgcgcggagctgcgcgcactgggtccccaagagcccgcgggcgtccggcagccgagcgcacgttctttcggatgcacacgcccgggtccctggcgtctgacgccgtggggagggcagcgaggccccaggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgtcattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccaacaccctcaccatccgcgtgtgtgactgtgatgctgacggcgtagcccagacctgcaatgcagaggcctatgtcctacctgctggcctcagtacaggagccctgatagccatactcgcctgtgtcttgacattattggtgttgatcctccttatcgtcactatgagaagacggaaaaaagagccccttatttttgacgaagaaagagacatcagagaaaatattgtgagatacgatgacgagggcgggggagaggaggacacggaagcgtttgacatggctgcactgagaaacctcaacgtcatccgagacaccaagacccggagggatgtgactccagaaattcaattcctgagtcgaccagcttttaaaagcatcccagataatgtcatctttagggaatttatttgggaaagattaaaagaagccgatgttgatcctggtgctcctccttatgactccctgcagacatatgcttttgaaggaaatggctcagttgctgaatcactcagctctttagattccatcagctcaaactctgatcagaactatgactacctaagtgactggggacctcgctttaaacgactcgcggacatgtatgggactggccaagagagtttgtactcatagccttggaaccttaattcgaaatgtactgaagaaaaagtaacagcaaaaaataaaataaaatgaaataaaataataaaccactacatacagaaaacaagaactccccttgctggagacagatggttgtaaatatttctccatttttaattgtttagatttctgccttggtgaggcatatcttcattagacttatctaaaggactgcactgaccacagactctgagcatttgaaggttttttgataaaaataaatgctcagtggtttgtgaatagatagcaactctcatatacctgcaaaggcaccaaacctctatgagaaagtagtgccctgtgttgtcagtgagtcaaagatgccctgtacataccttcatggtactgtcattgagaggaatagaacatgatgagctattgaaaaaccctggaacttgttgcatatcaaaacttgggacaaatttaatttacagagatgcttatagcttactatattatagaatccaacagaattatgttgctcttgattaacagaaatattttatttaggaatatataaattcccagaaattccttcctaactgaaaaccctaccacaaaagccagtaaaatttagtttaaggcaatataaaccattgtttatccaataaattatgaagtgttccaaataagaaaaaggtaaataatttgatagttttgagatgcttgtgtaggtatgataaaaaaaaaagttgctgtctgttcattgatttttattatctcttctgatttgtacaggagaatatcttttcttttttatttgacacatggtgttgtatttattttggagctccaatctccactaaattcaggtccatcatactgcctcatagtattaaactcatcagaacatgctgatttttctccagcccgagctacatgaaggaaatgaagcatggaaatggagaactaatagtaaagcaattgagccctgttgcaggtcacatctcaaagaggagcacagctacaaggacatataaattgttcttctgagccattagaatgtcaaaacattggaataaaatatttgtattttagaaagacttcagagagaattgagattttctttgatgcaagaattatttttcaagatcatgagttctacatgctccaaagacgatttcaagaacacaacctttcttgctgcaaacctattgagtaaaatattgagtttttaaaagtcttaatataatgttataaaaattaaaatccatctttaaattctgatgcaaatatgtccctcaagaattaaccaagcaatgtatgatttctgtgtggtttagatgtgccaaaggaaggaaggcaattgcaagtcatcatgtgtttaagtttgagttgagcttgttagagtatgactttcatgaccaaaatgatgtttctacctattatttttcctagattaatactagtttaatgtgcatatacattcaagtaagaatggatttattttttccttcctttctccttttaaaaataattcattgttgggttcctaatacatttacagatagtaaacactgtgtagagaatcatgttctaaaagtgctttttgaaaggtagacagtggaattagaatattaatatgttgattacacaaagaagaactatgtaggattctgtaaacttgcagcccaactttagaaatgaagtatgtaaaagtggccttcaacttcataagtataaataatccaataaatttcattacctgcaaacagttctttaatttgaatagagttttgtagacattgttttatgactatatagatatgcttcttgctgtattaatatgcatatatattttaaaaaattataacagtgaaagatactgttcataacttttaatcacacatgcaagtttttcaaactaaaaaataacaaacaaacaaaaaaacacgcgtatttacccagttcaataaaatcagagtgtggtgcaggaattacagagttgttaagtcagcaaggtgctgagaaaacagtttgtaataatccccttgttgtctgcaagaagatgaaatagtttagtacatttggatgatgtcaaaactgctgattgttgcacataccactaaacggaggtgtggatgtattttagaaaaggaacacacatcattcaccctgctttttctgcttttaaaatgtgtgttttttctcattaattttttcaaatggttaccaatgatagattggaaaaagaaaggttcatgtttaaataataatttaaaattattgcatatacccaattgctatttatgtgtggatgattatatgaatacagtattacatttcattcagtggtattttttaattaaaaaaattaatttaaaaaattaatttttgagatggctggaagaatgttcctaatataggtagtatttatatgaagtattctaagcttaattgtaatagtagtaaattttttgccgttgcttattttagttttcttttttcttctgaaatctaatgctatatatgatgactgtcaatacttgagatataggctttgttttaaaaacagtgattgaagagctgattgataaaattaatattaagtctagttggaaaattctccaaatatgatttaaataaatatatattatcaagttgcttaaattcagtattatactgaaaccaactagaatgagctcacaggaactaattcttcatatctcttcccaactccaggtacagtgatatcattttggtaggttgatgtcagccttggtgggattatttagaccacaacagtaatcagcaaacactacccttttctctggagaacaagttgttaaacatttaccagcactctactgcttaaattattttataaaatgaaatgtcataattgtaaatatagtatgaatttatatgatttaaaataatgacatgaaaggaatttatgctatattttactactaaataacaatgtatgtggtagtgatttcctgaagtgaaatccttggagctacttgtagacagggagaggagtcacttctttatggaaaacaatggctaaatttcaagtagagataatagttcaggaagtcaatatatttaattattttccacttgtccatacaggagcatcaatagaaactcagggtttgccaaattatgcccattttgaacagtttaatttattgaaaaatcagatgcattttacttcttactgtctatgtcaaggaaatacacccaagcccttaatctgaattgtcaccattgcattattaaaaatcaacataaaaatataaaaatcaaatcttaaggaaatggatttctggagatcaagcctaaattatcaatctcaattcacaaattagtctctgaaagaaatattccaagatcagccagctaaggaacaaaatcaggaaagagacatcaataaaaaattaggtagtaatttgcaggcaataagtagatttttgatttttctacaagcaatcaccagatctgggatctggtaaatgtctttatttgccaggaagctctgctgatgactacaattgaggttagttgtctacaagatacatgcaggaggtagtagtggttaagtaatggtagctgccttttcactctgccctctgaggaagttttaaattattttatcttcatgcacaattacatttactacattggatggtagacataggcaattattttcatgtcaacggcatagttacacaatgtaggaatgatatttgtgaagtgatccacatgcccaagaaatgcaaatgcaaatagtgttgttagcatttatattgaaatataaaatctaaagcagcttaaaataagctaagctaaacaaactgcaagaagctaaatgatttaaacatgttaaagttttaaagcactagctgtaaatattaatcttcagattttcaatttaacatgtattcacttacaaactgttctaataataacactaattattttccaagtcaccatttaaagttttatttacagttgacctaatccaattgaagttgatgaaagcttcaacttattttttaactctttctggtccacgatgcctggaggcaagtgaaatatatatgacaaataatagataaaccaatttattttctgttagtgtatgtttattttttaattattaataatgtatattgtgtgtatatatgacggtgtatgaaagttggcaatgaaagctaatacaatcatgttagtcggctggatataataaagaacaagaaaggaataatagcatttgcattttaaatgtaattgaaactatttcagaagagtgggataagcccttaagaaaaatgggagatgtttaaggctgtgatttggccgacattgtaacgtataattctgtgggaaatttttcaagcaaatcaagacaggcagtgtgcgttgcattctgacactttttcattgttatgctaacttctactggcttagaatgtaactgaaaaggatgtgtgcctgtgtttttttttttttttttttttttgacgtggagtctcgctctgtcgcccaggctggagtgcagtggtgcgatctcggctcactgcaagctccgcctccagggttcacaccgttctcctgcctcaacctccggagtagctgggactacaggcgcccgccaccgcgccccgctaatttttttgtatttttagtacagacggggtttcaccgtggtctcgatctcctgacctcgtgattcgcccgcctcggcctcccaaagtgctgggattacaggcgtgagccaccgcgcccggccctgtgtgtgcgttttcatgtgtgtgattgggaaccttgagagatgtatctgaagtaatgtaaaaataagagtctcataattcctggttaatgctggcgtattgttgtcacctgccaagtgactgttaggcaataagactagaaaatatggtaccgaatgaaaggagaaatatcttatttgctgtaacaatctaatttatattaaggtaaggattttggtggctaaggaaagaacatttagctgttatttgtgtaattgtcacatattattgtgcagatttaatctcattgttaacagaatatagagtgtgaattatttgttattaaatgttactgggctttggtgtcagtgtggtataccagaaattacctctggtctgtggttataaaatctaggtcagaagctcagtttcgccacatttttgctgtgccctagatgccattttcattctctgaacttttatagcttcatgattaaaattgagttaattactattgtgtttcagaggcttgtgaatgattaagtgaaagactgtgtaaacagtaaaacactataaaaagataaagctttattatgggaaataatgggaattatataaaaaggttgataattgttatatggtaaacagagaatttctgtttggagatacatacattaaggaaaaatatatgcaacttggtatcctaaattggaaaataatattcaaatagataattgtcataattaattgaagccactcaaatacagttatttataagatctcagaagattgcagtttaactcaacataattcaaccattcatatgaattaatgatatccatatgtgaatgggattataaataaagaacaaatctttcttacttataatgataactgagtggaagataaaggactgcctttagatgatcccagcctcattgatgaacacaaaacaccagaatagagaaaaagacaataatgagtataagttaagtggtcttccaggcatccagagtagataaagaaaatgaagttctagagaatacaatactttttaaagtcacagtgacatatgtgtaattaataatttatacacttgaaaaaattagatgcaatgatattgacttaacatgaaaaccatcctgaatgcaatgcactcttgatgactcaaactcacttatatcttacaacagctcatcttaatctcttacgaatgaagaaactctaggaaactaaaaaataatatataatggatattactttttgtcagtgatgccaagatgaatgttaataagctctcttctcaactttagctcttagttatctggttattttatgctcatgtgaacagacactagaaacaaatatattaataactatgtaactaatgagaatgttgaaagtacagcatactttcattcaaaaacaaacttgcattttcattttattaatgaatataatgatgttaatggtttatataagcaggaaaaacttatatgattcactaccctacagcttcatgttctaattttgtgagtataaaccctatgtttttgtatatcaagatctggaatatgttgtatactgtatatgaccaatactttaagaacaatcaagtttttttattattattattatactttaagttttagggtacatgtgcacaatgtgcaggttagttacatatgtatacatgtgccatgctggtgtgcggcacccattaactcgtcatttagcattaggtatatctcctaattctatccctcccccctccccctaccccacaacagtccctagagtgtggtgttccccttcctgtgtaactatatagcaatttcattttacatgcagtaattttaaatgcccaaaaataaaaggaaaaggaaaaataagtcactacacaacttatatatattatgtatttgtctttgaattttgtgtgcgtatgtgtgtgtgtatatatagacagcatgcgcacacatacatacacgtgtgcaggaacacacacaatttgaggcgaaatgttgaagtaaagtaaatgacttttaaatattttctttttagcttttaagatgtctattagatccaacctctacaattaaattatatgagcatactgagggagaattgcacatttgtaaagtttctctttagtagagatttcagaattttttttctcaaatttagaggaacgaacaattcacattagtaaaacacacagcattactttcaatgaaactataatttttatgtttatgagattccattataattacattaaaaagaaaaccacttttataatatttttgcttatgtaagagtcacttctatagtaaaagagccttaaaaatgttaattcaattgactgcagaattgatcctgaaaatccagttcatttaaccttggaaatgagacatgaagcataaaacctggggtcaggatgtatgtccaaactgaatagattattttcgttcagctcaagtgctatctttcaggcaaatagactcctacaatattcagtattggagatgtttaaaacaaatataagaaagagtactgtttcagaactaaccagcgaagagatgtatacaaagtgtactctgaattggaataagtgtaggaagacaagccgtgagaatgtgagacctcagtatattgctgtgttttattgtgtgttttgctgtatttttaaaaaataagaaaaaattatcacagagtaagatacatagaagaaaataatttccgcaattcttggtacctcaaaagacctgacacactacaatgaagacttctgttgtcatcattctcagctgtgatggtggcgccatcctggtttccagcttatacctcctgacaactcggtacagaaaatgagtatcattgtaattaaagtttgatattttcttctaagtgactgatttttaatataaaagtatcacaataaagtttttccacagatatgtaattttaagttagataacattctaacatatacatggtttcaattttcttataagtctgtgaatcactcaagttaggcattgttaggttttttaaggaaaaactttgatgcccagaataactgtaacttatgcaaacacacacacacacacacacactcacacacacacgaagtaaatggtagaaatgaaagaagaagaagaagaaaaaaacattgggacattttgccctttatctttttattaagactgtcaataaatgatggtttggtttaagaggataagaagatagctgaaactctaataattggactttccaatcttaattatgctttagttcccttaccaggattaggaaacttctttgtgattcttttttaaaaataatttaatcaggaagtgacattaaattctgtttcaatgtaatgagaaaatagaaatatttatattgtcattacgatggcacttcaccagtatgtcctaatctattctctattacgtctctgaggtgggacattgttgtgagaatggacgagagcacaaaaacacggcagaccagattttctgagggttacccgctatgcagattcataaacttgttattgaatagttggcacacaagggtaggagaaaaatcccaacaacccttccaccttttccaaaaagaaaaaaaagaaagaaaaagctaaatcttatgaagctaaactgtcaacaaacagttccactgaagttgccatagggacagctccaacccagtgctgggctcgtggaaggcagcaaggtacctgcatcaagccaagatccatgaaagtgctaatgtcatttgaggccagtttcacccctacctcccataaatcattttaaaccaaatatgaattagtagtcaaaaatgaccaaacacagacgataacccaccatgaaggagatggttcatagaaatctccaagaacttcagataattcaggtaattatcagaaacatgacaagaaaaagctttgtgtaaaatacagaatacaacacaaggaataatgaaaagatgatctatgatggtgtatacttgcaaaataactaaagagtgtatttaagatttaaatatatctttgaagctagaagtactatggagattgtatatactatattagacactgtgcaagaaggaacttgtgaagctaaaaaatagaatgcaataaattagctagtctgccacatagagaaaaaaagataatctgcaagaacataagggacaaggataaaatacggagtttaacgtgcttataaccagtgtgatccttgttaatcagaattctagaatgttccattgccttatgtgacacctccactgcccccactttttctttttttttgacaaggtctcattatgtttcccaggctggcttttaactcctggcctcaagttatcctcctgcctctgcctccttaaatactggaattacaggtgtgagtcaccatgccaggtgtctcccattttttaatggtagcttaacttcacctgaagcctcctatgccactatctttataggaagctttaccgactttgtacgacttggtttaatttattcagcttaatggtccatttaaccaatattgttataaatttatgaagcttcaattctagcaaaaataaactatgtgcactcatcaaaatgtgtggcacacctatgaaaagtgatcaggatgcccaagcaattttaattaaaatcagataattaaatatg

SEQ ID NO: 112851 - DNA, 3766 bp, Homo sapiens
  Payload ID: 2082
  Gene Symbol: CDH7
  Gene Name: cadherin 7, type 2
  ENST ID: ENST00000536984
  CDS Start-End: 695-2587
ctgggaggcgccgaagtctcagtggctccctgggccggcctccgacagcgctgacagcaggcgcccgccgcccaccatcgtcgccctcttcccctccctcttcggccccggctccggcgcgctctctcctcctctcctgcgcgccctctcgccctctctctggccgcgcgctcccgctggctccggaccctgcgtctcagctgcccgggcgagccggaggggcccctcgcagtgagcagacgcagcgggcccccggcgcccgaggccggggcagggtccccgcgcaccgcggagtgggctgtgattggaggaggagcccgtgccgggcgggcccgagcgggtgtcgagccggttcctccagtctgccccgcgcgcggagctgcgcgcactgggtccccaagagcccgcgggcgtccggcagccgagcgcacgttctttcggatgcacacgcccgggtccctggcgtctgacgccgtggggagggcagcgaggccccaggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgtcattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccaacaccctcaccatccgcgtgtgtgactgtgatgctgacggcgtagcccagacctgcaatgcagaggcctatgtcctacctgctggcctcagtacaggagccctgatagccatactcgcctgtgtcttgacattattgggtaggtactgtttccagggcttgctctgaaagagctgtcacaataaccacatgtcacgacttgcctattatcttctccatttggtgaacatatgcagatattctactggatggtgtttgttttgttttgtttttctttgagacggggtctcactctgttgcccaggctggagtgcagtagaatgatctgggctcactgcagcctctgcctcccaggttcaagcaattctcccacctcagcctcccgagtagctgggattacaggggtgcaccaccacacccagctaacttttgtatctttagtagagactgagtttcaccatgttgggcaggctggtcttgaactcctgacctcaggtgatccacccaccttggcctcccaaagtgctgggattacaggagtgagccacagctcctggcctggatggtgttttgctcactaagtaatacaattgttggccacactttccagtggtatatttgaagtataactcagacaaaaagttgtatcaatttcattttcaaagcaacagtgaagataaatggcttatgctttaaattaatgctttttaggattaaaaataatctatcttatcccagttctttgctttagagcactctacagaggagatacactagactggagaatacattttctatattgttttgacaatatgcttattttagaaattatggctttatattctactttttaaagaaattatttgattgctttcttaaattatttgcaaatttgaaatgattacaatttcagcaatgcaaatcttatatttttaaagtattaaatactaacacatttaattgtacatttccatgattagtttattactcggttaaattaaatttataactcatatttgcagtaactcagattttgcagcatccttttaaaaattgggagatgtccaatgtggacactgggtaatgggtttattccaaagaaacatttttcttcacattgtaacttgtaacacgaacacaacaagaacagagtaaacattcaatataccgttccatatggtgaatgttcaataaattttaagtgttactgatggaaaattataagctaagacctagttactaatacattataaatgctgtcgtgaaaatggaggttattgtcttaagtaacttaagctaaacaagtaaatctaaaagaaaataaactatattttgcatagaacttta

SEQ ID NO: 112852 - DNA, 3728 bp, Homo sapiens
  Payload ID: 2083
  Gene Symbol: CDH8
  Gene Name: cadherin 8, type 2
  ENST ID: ENST00000299345
  CDS Start-End: 956-3193
aacataacgccagccccagagctcaggtgagacctctagagagaaagctcgcaggtacctcatccgcatgctgttattatctgccagcccacttatccaggagctcggtcctcagcgggctgcgcgcaccgcgcggaagggcgcatcttcacctcgtggctctggcggcagagacgcgcggggcttgctcgggagcgaggagcgaaaagttgtgcgcccacttgggtagggggaaagagagcgatcgagccagcgcgggagagcgaagggggaaggcggggagggggcggggaggggggactgcttacatgaatttccaagtggtagacctgcctctgcgctctgcccaatgagatccgtcaggggaggcacccggctcacttttccacatcacttcacagttacatttggcaggcaggcgggctcgcacgccggagcgctcagcccagaattagtggatttatttggaatctccctgcctcctccaagctccgccgccgccgccggcttgtgcatagacggtagcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaagattacagaagagggttgctaggaggaatatcacaagatgctgtctgaagagaaagactgtggaaaaccatggcttcaatgaactcagaggtcaggaccagaaaaggaaatgagaggtcaccaaagccaaatgttaatttcttgggatttcttctgtacatgcaaagaacttcaggccatcctatgattcctcaaaaataagaggaaaattttaacaattatgctctaagatggaccatgacaatttaggagtcattgggatcaccccccaaagccaaatgttaatttcttgggatttcttctgtacatgcaaagaacttcaggccatcctatgatccctcacaaataagaggaagattttaacaattatgctctaagatggaacatgacaatttaggagtcactgggatcaccccccccacctttccaacgttactctgctttaactacaaatatgtcgaatggttttctaatttttctttaacttaacctctaaagttcgagagctgtcatctttgtcaagtctgattgttgagtatgtgaatggatgtttttggctcaatgttagagccaaaatttataaataataattatttatacataatgatattgcaaataaactttaagaaagagctttaaacataaaaa

SEQ ID NO: 112853 - DNA, 8009 bp, Homo sapiens
  Payload ID: 2083
  Gene Symbol: CDH8
  Gene Name: cadherin 8, type 2
  ENST ID: ENST00000577730
  CDS Start-End: 200-2434
gaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccggtggggcttgccaattcagtggtgggaggagagaaatcccattcaaacatgcttgttttctagaagcaggattcctcgttccctcctcttcatcttcttccacaaggacacaaagataaactgtatcacacagtggactacataagagacagatggttttattgctagcgcgtgaatttatttgtttaatcctcgaaataaatattttattgatgtccattaatgcttttatttattaaggtcggtaatctatagattaaggggatatatgggaaaaaactaaattatatccattaataatcctttagattgttttatataaatatatatacaatgaatgtttaatacatgtacattttgatgagatgagtatggcaggcaatattatcgaaaggagagctaatagtctctttagagtagaaagtgttattgtaactggagatggcaggaacagcatcttcccagacaaacttttggactgttttctattttgttcataatcctagtatttggtgtttttactacaagcacaaacatcctaaagtatattgattcctgtgaatatttaaactctagacttttagatacctacatcatgccctgcccaataaacatgcttcaatttacccccacagttttagagcaggaactgatttgtacataatttcactgtttacgtttttagcactcctatccctgatcttcatggtgatgcacagaatgtcttagactccaaaaaggaacagcactagaagatgtgagcatatttaatttgtaatgcaaacctgccatttaggagtagaaaatgtatgataaaactcaagtattacatgcagatcattttaattttctactttgctttaatgcaatattgtttattcactccatgtattgtattcagagaaactcctgtattgtttcctactttgtgaaatatatttttataaatacctttgttgtcattaatttttttttcaatcagtggaagatctattaacagaatcatcaactcaaactaaaattctagaatactcaaccaaatcatcccaagggtcacttttgtttgtaagactctttattatagagaaacagagaagagaaatggcttgccagtgatcacacagcaagataccagcagggacataagaggaacatggaacacctaaaggctagtccagctgtgtcatttgggtccttctggaagcagacgcattgggcagggaaaaccttcagacaagtttgcagacctaaaacttgtaacaatagagggattgggagcaggatttggcaagagagtcttagactgcagtgcggacctggcaaaatctctgccagtctgacagggggttctagagtgaaaacacatccattaaagcagtcaggctgtggtcctctgtcatctcagtcattggtgcggggctgctaagaagagaacggtttttgactcaaaagctgaacgcaccaacttctagaggccaccttcactgtgacagaaactgcatgtttaaatactatactaacaatttataactatccggtggcttaatcaactttttattgagtttctgttgctgagaataagtcatcttttatgcgtattattacggctagtgaacactttttcttgaggtcaaagggatggtccaacatgactttaaaatatactaggacttggcacagtgtctaaaacaagtgcttggtgaatgtaaattattagtagtagttgcagtaataaccaatagtaatattccaactatcttacaccttccaaaccaaggagagattattatgttttatgtatctcttgaacaccagactcatttctagtgtactttgaagtgcccaaagattatagacacacaaatatgtctaacagaataattacagtattttttaaggagtataaaatctgtatcctcaaatattggtaatcaacaggataatcttcgtacagtggtttctgtgagcaggagataatgtctgctctactagttgcccaaatatcgcctaagtattctctttgcctaggaacacagaatgaaagcttgcatctcttgctgactttctttgccaccacagtgtcagcattttgtgtttaaaagcctatttcaggtcttgtaacatagaataaagtgactaataccttgatcctaataagattgacctatacttttagagtgtcatgaattaaactaaaaatctcaggaactatctctctctttctctctttctctctctctctctctctctctctcacacacacacacacacacacacacacacacacacaacaaacaaataaaaaacacacattttgacttgaagttttactttagcaatagacttgccaggactttcccaaccaaaagatatcaataaggttcctaacattttctaagatttaagtatcccatgctcaatttgttaaataacacattttaaaaactttattgaaatgactatatttttaaagctatgtgcattgttgtctgtttcatcaacattgacatagcagaaacaagagtactctctgctaaatagagaagaatgattaagttggagccaagtgagacaaagttatctccctctgcctacctcacaattcaaggttcccacctagggaactgatgcatccctgggtgattggacacaacatgggatcaattcagcctctactctgcctatgatttgatcaaatcatattagcaaagtgtctcttaaacatccatatatgaatattaaagagtattaaggggggcatttcttaacaatatttttatgagtatagttataagtttctaaacatttataatacgatgactaaaatatgctatttttaaattcaagtgttaaccttgccacacagaattatgacttctagggtgtaaactttaaagtgaaactgttttgaaaaaaatctgcagttaagtgtatgtgtatatatagaagaaaaggaaacttagatttactggtatcaccagtgaagcaagaatgcttagaaagatacaaatgtgtctttgggagagtctgcttaatcagatgcttaaagtaagacaagtctctgcatgagacttagaaatctcctaggagcagctggattccacactgagactcaacagagttctgggctatgctgtattttggaaaaggaaaagcgggtgctgagagctaagtagccaattactctttatagccacataaggactgaaggcaagtaggcccttccaacaagttgtattatgcgatcactggctttgcagggaatctcacgaatgtataaccttctgattgcctttttgattgaaagttccatctgagatcagggcagtgtaaccagtaataagatttcaaaaaaatcccatcactggcactgtcggaaaggctgagcatgactgaaatcctatcattgtcagtcaaaaagataaggtaacagcgggcatcactataaaagctctataaatgcacaacttaaacatgaatatcaacattaaaaagaatatatatatccttatacatatatttataaatatattcatatatataaatatgcacatatatacacaattcagttactggggataatttatagttttaatttttcatctcataatctcacgcactgccaacaaattgaaattgtggctctctgttttcatgaatctaaccttgaatttgaaagaagttgaattgagggtaaagggttttaaaagcagctttttatttgtgaacagaataatggctcataatacctgggattagaattaaatatgtcacgttgtgaggctgtacttagactttttaaatgtcattgtatttttttgtggacaaaataattgtagaatatactttgcaggaaatacttttctatattttttcaatttcaatactgttttatttgctataaaaagtgtctttgcactgttactcagccaaacagtgttgaatgtattatttgcccttgtaattattgcttcttatgataattgtagaagagcatgtctttatgatctatcatttaaaaatacatttattgtcattgtagttttagtcaacacaaatttatggattacatggtatactgttgctattgaagatattctagtcctagtattttgagcacagacctagcgttatggaggacataaaatttaaaaatttcctgacttgatggactatctgaggaaaaagaattttgtctgtcacatttattgagtatctatcagtacagaaattaagctacatggttgatacagaaagattaaatacagtagcattctcaaacttattttctttatttataaaatgtacctaatcaatctcataagaactaattgttgaattttttttttatctatggataaatactatttgagtctgggtttaagtttggttgatctgacactaaatccccttaactttcaactaaacagttatctctgtaattatgagacttttgatgataagaaatagaaactaagttatatatagtgctatggaagtactgaggaggaagtaagggaccccatatgggaagactcaagaagacgtcacggtgaaattttccaaaaagatgggaactcaagaatgggtgcaacagaaatcacagcttttccaaatactaaaagggaaaattataaaaagcaccaatggcacacttttggacattcagaaagatccagaaattaggtgcttataggaaactctaggtttgccaaattgtagtgttttatggataggaaaaatgaagttcagaaacgttataaggaattttcagggttaaattacacatcaaatatgtgagagaaacagaaattacatgctggtatttggggtcatctcctgagttgtaatgttgtaagtgtttttgtatgtattctcctccttcctttatgtgtggaagtttcatctaggtctcaaggttagtaggcatttgctggtgaaaatagtgcctttgggtactatttccccaacttgagttacctgccaccatctaattcacatcttgaatgcaagtattatttcttgcaagtatccctactaatagataatagatatttctattattatccacagattacagaagagggttgctaggaggaatatcacaagatgctgtctgaagagaaagactgtggaaaaccatggcttcaatgaactcagaggtcaggaccagaaaaggaaatgagaggtcaccaaagccaaatgttaatttcttgggatttcttctgtacatgcaaagaacttcaggccatcctatgattcctcaaaaataagaggaaaattttaacaattatgctctaagatggaccatgacaatttaggagtcattgggatcaccccccaaagccaaatgttaatttcttgggatttcttctgtacatgcaaagaacttcaggccatcctatgatccctcacaaataagaggaagattttaacaattatgctctaagatggaacatgacaatttaggagtcactgggatcaccccccccacctttccaacgttactctgctttaactacaaatatgtcgaatggttttctaatttttctttaacttaacctctaaagttcgagagctgtcatctttgtcaagtctgattgttgagtatgtgaatggatgtttttggctcaatgttagagccaaaatttataaataataattatttatacataatgatattgcaaataaactttaagaaagagctttaaacataaaaa

SEQ ID NO: 112854 - DNA, 9721 bp, Homo sapiens
  Payload ID: 2083
  Gene Symbol: CDH8
  Gene Name: cadherin 8, type 2
  Uniprot ID: P55286
  ENST ID: ENST00000577390
  CDS Start-End: 956-3355
aacataacgccagccccagagctcaggtgagacctctagagagaaagctcgcaggtacctcatccgcatgctgttattatctgccagcccacttatccaggagctcggtcctcagcgggctgcgcgcaccgcgcggaagggcgcatcttcacctcgtggctctggcggcagagacgcgcggggcttgctcgggagcgaggagcgaaaagttgtgcgcccacttgggtagggggaaagagagcgatcgagccagcgcgggagagcgaagggggaaggcggggagggggcggggaggggggactgcttacatgaatttccaagtggtagacctgcctctgcgctctgcccaatgagatccgtcaggggaggcacccggctcacttttccacatcacttcacagttacatttggcaggcaggcgggctcgcacgccggagcgctcagcccagaattagtggatttatttggaatctccctgcctcctccaagctccgccgccgccgccggcttgtgcatagacggtagcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaaggcaagggcttgctccagttccaaatggtgttgatgtcgatgaatttataaatgtaaggctgcatgaggcagataatgatcccacggccccgccatatgactccattcagatatatggctatgaaggccgagggtcagtggctggctccctcagctccttggagtccaccacatcagactcagaccagaattttgactacctcagtgactggggtccccgctttaagagactgggcgaactctactctgttggtgaaagtgacaaagaaacttgacagtggattataaataaatcactggaactgagcattctgtaatattctagggtcactccccttagatacaaccaatgtggctatttgttttagaggcaagtttagcaccagtcatctataaactcaaccacattttaatgttgaaccaaaaaaagataataaaataaaaaagtatatgttaggaggttataaatcttgtggagtgtgaattaagtatgtggagtgtctagaagtccttggatatttgatatttacctgaccaccacagacaaagattgggatcctggctaatccttagataaatggtttaaatagaggaaaaaatcataattaaaaggtgctttcttagaaaaaaaaatacggacctgcaaggaatctgctgctgatatgtgtcttctgcaaggatttttatgaatgcaaatggttttttccccttcaccaataaggatcccgccacaaatgataaagcaatacttggtctgctgtacattataactttttggagttttgagaggcctcctagattatacagtacggtgaccacacattgtacataattgttggccccactcactagagactgaatagcatctttaaatattgtgtcgagccttaaaatattcacatgttcgtaatccattccagggtggggcttgccaattcagtggtgggaggagagaaatcccattcaaacatgcttgttttctagaagcaggattcctcgttccctcctcttcatcttcttccacaaggacacaaagataaactgtatcacacagtggactacataagagacagatggttttattgctagcgcgtgaatttatttgtttaatcctcgaaataaatattttattgatgtccattaatgcttttatttattaaggtcggtaatctatagattaaggggatatatgggaaaaaactaaattatatccattaataatcctttagattgttttatataaatatatatacaatgaatgtttaatacatgtacattttgatgagatgagtatggcaggcaatattatcgaaaggagagctaatagtctctttagagtagaaagtgttattgtaactggagatggcaggaacagcatcttcccagacaaacttttggactgttttctattttgttcataatcctagtatttggtgtttttactacaagcacaaacatcctaaagtatattgattcctgtgaatatttaaactctagacttttagatacctacatcatgccctgcccaataaacatgcttcaatttacccccacagttttagagcaggaactgatttgtacataatttcactgtttacgtttttagcactcctatccctgatcttcatggtgatgcacagaatgtcttagactccaaaaaggaacagcactagaagatgtgagcatatttaatttgtaatgcaaacctgccatttaggagtagaaaatgtatgataaaactcaagtattacatgcagatcattttaattttctactttgctttaatgcaatattgtttattcactccatgtattgtattcagagaaactcctgtattgtttcctactttgtgaaatatatttttataaatacctttgttgtcattaatttttttttcaatcagtggaagatctattaacagaatcatcaactcaaactaaaattctagaatactcaaccaaatcatcccaagggtcacttttgtttgtaagactctttattatagagaaacagagaagagaaatggcttgccagtgatcacacagcaagataccagcagggacataagaggaacatggaacacctaaaggctagtccagctgtgtcatttgggtccttctggaagcagacgcattgggcagggaaaaccttcagacaagtttgcagacctaaaacttgtaacaatagagggattgggagcaggatttggcaagagagtcttagactgcagtgcggacctggcaaaatctctgccagtctgacagggggttctagagtgaaaacacatccattaaagcagtcaggctgtggtcctctgtcatctcagtcattggtgcggggctgctaagaagagaacggtttttgactcaaaagctgaacgcaccaacttctagaggccaccttcactgtgacagaaactgcatgtttaaatactatactaacaatttataactatccggtggcttaatcaactttttattgagtttctgttgctgagaataagtcatcttttatgcgtattattacggctagtgaacactttttcttgaggtcaaagggatggtccaacatgactttaaaatatactaggacttggcacagtgtctaaaacaagtgcttggtgaatgtaaattattagtagtagttgcagtaataaccaatagtaatattccaactatcttacaccttccaaaccaaggagagattattatgttttatgtatctcttgaacaccagactcatttctagtgtactttgaagtgcccaaagattatagacacacaaatatgtctaacagaataattacagtattttttaaggagtataaaatctgtatcctcaaatattggtaatcaacaggataatcttcgtacagtggtttctgtgagcaggagataatgtctgctctactagttgcccaaatatcgcctaagtattctctttgcctaggaacacagaatgaaagcttgcatctcttgctgactttctttgccaccacagtgtcagcattttgtgtttaaaagcctatttcaggtcttgtaacatagaataaagtgactaataccttgatcctaataagattgacctatacttttagagtgtcatgaattaaactaaaaatctcaggaactatctctctctttctctctttctctctctctctctctctctctctcacacacacacacacacacacacacacacacacacaacaaacaaataaaaaacacacattttgacttgaagttttactttagcaatagacttgccaggactttcccaaccaaaagatatcaataaggttcctaacattttctaagatttaagtatcccatgctcaatttgttaaataacacattttaaaaactttattgaaatgactatatttttaaagctatgtgcattgttgtctgtttcatcaacattgacatagcagaaacaagagtactctctgctaaatagagaagaatgattaagttggagccaagtgagacaaagttatctccctctgcctacctcacaattcaaggttcccacctagggaactgatgcatccctgggtgattggacacaacatgggatcaattcagcctctactctgcctatgatttgatcaaatcatattagcaaagtgtctcttaaacatccatatatgaatattaaagagtattaaggggggcatttcttaacaatatttttatgagtatagttataagtttctaaacatttataatacgatgactaaaatatgctatttttaaattcaagtgttaaccttgccacacagaattatgacttctagggtgtaaactttaaagtgaaactgttttgaaaaaaatctgcagttaagtgtatgtgtatatatagaagaaaaggaaacttagatttactggtatcaccagtgaagcaagaatgcttagaaagatacaaatgtgtctttgggagagtctgcttaatcagatgcttaaagtaagacaagtctctgcatgagacttagaaatctcctaggagcagctggattccacactgagactcaacagagttctgggctatgctgtattttggaaaaggaaaagcgggtgctgagagctaagtagccaattactctttatagccacataaggactgaaggcaagtaggcccttccaacaagttgtattatgcgatcactggctttgcagggaatctcacgaatgtataaccttctgattgcctttttgattgaaagttccatctgagatcagggcagtgtaaccagtaataagatttcaaaaaaatcccatcactggcactgtcggaaaggctgagcatgactgaaatcctatcattgtcagtcaaaaagataaggtaacagcgggcatcactataaaagctctataaatgcacaacttaaacatgaatatcaacattaaaaagaatatatatatccttatacatatatttataaatatattcatatatataaatatgcacatatatacacaattcagttactggggataatttatagttttaatttttcatctcataatctcacgcactgccaacaaattgaaattgtggctctctgttttcatgaatctaaccttgaatttgaaagaagttgaattgagggtaaagggttttaaaagcagctttttatttgtgaacagaataatggctcataatacctgggattagaattaaatatgtcacgttgtgaggctgtacttagactttttaaatgtcattgtatttttttgtggacaaaataattgtagaatatactttgcaggaaatacttttctatattttttcaatttcaatactgttttatttgctataaaaagtgtctttgcactgttactcagccaaacagtgttgaatgtattatttgcccttgtaattattgcttcttatgataattgtagaagagcatgtctttatgatctatcatttaaaaatacatttattgtcattgtagttttagtcaacacaaatttatggattacatggtatactgttgctattgaagatattctagtcctagtattttgagcacagacctagcgttatggaggacataaaatttaaaaatttcctgacttgatggactatctgaggaaaaagaattttgtctgtcacatttattgagtatctatcagtacagaaattaagctacatggttgatacagaaagattaaatacagtagcattctcaaacttattttctttatttataaaatgtacctaatcaatctcataagaactaattgttgaattttttttttatctatggataaatactatttgagtctgggtttaagtttggttgatctgacactaaatccccttaactttcaactaaacagttatctctgtaattatgagacttttgatgataagaaatagaaactaagttatatatagtgctatggaagtactgaggaggaagtaagggaccccatatgggaagactcaagaagacgtcacggtgaaattttccaaaaagatgggaactcaagaatgggtgcaacagaaatcacagcttttccaaatactaaaagggaaaattataaaaagcaccaatggcacacttttggacattcagaaagatccagaaattaggtgcttataggaaactctaggtttgccaaattgtagtgttttatggataggaaaaatgaagttcagaaacgttataaggaattttcagggttaaattacacatcaaatatgtgagagaaacagaaattacatgctggtatttggggtcatctcctgagttgtaatgttgtaagtgtttttgtatgtattctcctccttcctttatgtgtggaagtttcatctaggtctcaaggttagtaggcatttgctggtgaaaatagtgcctttgggtactatttccccaacttgagttacctgccaccatctaattcacatcttgaatgcaagtattatttcttgcaagtatccctactaatagataatagatatttctattattatccacagattacagaagagggttgctaggaggaatatcacaagatgctgtctgaagagaaagactgtggaaaaccatggcttcaatgaactcagaggtcaggaccagaaaaggaaatgagaggtcaccaaagccaaatgttaatttcttgggatttcttctgtacatgcaaagaacttcaggccatcctatgattcctcaaaaataagaggaaaattttaacaattatgctctaagatggaccatgacaatttaggagtcattgggatcaccccccaaagccaaatgttaatttcttgggatttcttctgtacatgcaaagaacttcaggccatcctatgatccctcacaaataagaggaagattttaacaattatgctctaagatggaacatgacaatttaggagtcactgggatcaccccccccacctttccaacgttactctgctttaactacaaatatgtcgaatggttttctaatttttctttaacttaacctctaaagttcgagagctgtcatctttgtcaagtctgattgttgagtatgtgaatggatgtttttggctcaatgttagagccaaaatttataaataataattatttatacataatgatattgcaaataaactttaagaaagagctttaaacataaaaa

SEQ ID NO: 112855 - DNA, 559 bp, Homo sapiens
  Payload ID: 2083
  Gene Symbol: CDH8
  Gene Name: cadherin 8, type 2
  ENST ID: ENST00000584506
  CDS Start-End: 316-559
gaatgcgctccatcacagaaccgcgacacacagcctctacatagcgtctgagttgcaggcaggggtctcacaatcaccctattctgtacgcaagaggcccttggaataaagaggaggaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttg

SEQ ID NO: 112856 - DNA, 1528 bp, Homo sapiens
  Payload ID: 2083
  Gene Symbol: CDH8
  Gene Name: cadherin 8, type 2
  ENST ID: ENST00000583382
  CDS Start-End: 252-1528
aaggctgggaaacggtaaaaaaacgtgctgccgccaacgctgatgccaacaggaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataag

SEQ ID NO: 112857 - DNA, 9076 bp, Homo sapiens
  Payload ID: 2083
  Gene Symbol: CDH8
  Gene Name: cadherin 8, type 2
  ENST ID: ENST00000585315
  CDS Start-End: 433-1863
agcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaaggcaagggcttgctccagttccaaatggtgttgatgtcgatgaatttataaatgtaaggctgcatgaggcagataatgatcccacggccccgccatatgactccattcagatatatggctatgaaggccgagggtcagtggctggctccctcagctccttggagtccaccacatcagactcagaccagaattttgactacctcagtgactggggtccccgctttaagagactgggcgaactctactctgttggtgaaagtgacaaagaaacttgacagtggattataaataaatcactggaactgagcattctgtaatattctagggtcactccccttagatacaaccaatgtggctatttgttttagaggcaagtttagcaccagtcatctataaactcaaccacattttaatgttgaaccaaaaaaagataataaaataaaaaagtatatgttaggaggttataaatcttgtggagtgtgaattaagtatgtggagtgtctagaagtccttggatatttgatatttacctgaccaccacagacaaagattgggatcctggctaatccttagataaatggtttaaatagaggaaaaaatcataattaaaaggtgctttcttagaaaaaaaaatacggacctgcaaggaatctgctgctgatatgtgtcttctgcaaggatttttatgaatgcaaatggttttttccccttcaccaataaggatcccgccacaaatgataaagcaatacttggtctgctgtacattataactttttggagttttgagaggcctcctagattatacagtacggtgaccacacattgtacataattgttggccccactcactagagactgaatagcatctttaaatattgtgtcgagccttaaaatattcacatgttcgtaatccattccagggtggggcttgccaattcagtggtgggaggagagaaatcccattcaaacatgcttgttttctagaagcaggattcctcgttccctcctcttcatcttcttccacaaggacacaaagataaactgtatcacacagtggactacataagagacagatggttttattgctagcgcgtgaatttatttgtttaatcctcgaaataaatattttattgatgtccattaatgcttttatttattaaggtcggtaatctatagattaaggggatatatgggaaaaaactaaattatatccattaataatcctttagattgttttatataaatatatatacaatgaatgtttaatacatgtacattttgatgagatgagtatggcaggcaatattatcgaaaggagagctaatagtctctttagagtagaaagtgttattgtaactggagatggcaggaacagcatcttcccagacaaacttttggactgttttctattttgttcataatcctagtatttggtgtttttactacaagcacaaacatcctaaagtatattgattcctgtgaatatttaaactctagacttttagatacctacatcatgccctgcccaataaacatgcttcaatttacccccacagttttagagcaggaactgatttgtacataatttcactgtttacgtttttagcactcctatccctgatcttcatggtgatgcacagaatgtcttagactccaaaaaggaacagcactagaagatgtgagcatatttaatttgtaatgcaaacctgccatttaggagtagaaaatgtatgataaaactcaagtattacatgcagatcattttaattttctactttgctttaatgcaatattgtttattcactccatgtattgtattcagagaaactcctgtattgtttcctactttgtgaaatatatttttataaatacctttgttgtcattaatttttttttcaatcagtggaagatctattaacagaatcatcaactcaaactaaaattctagaatactcaaccaaatcatcccaagggtcacttttgtttgtaagactctttattatagagaaacagagaagagaaatggcttgccagtgatcacacagcaagataccagcagggacataagaggaacatggaacacctaaaggctagtccagctgtgtcatttgggtccttctggaagcagacgcattgggcagggaaaaccttcagacaagtttgcagacctaaaacttgtaacaatagagggattgggagcaggatttggcaagagagtcttagactgcagtgcggacctggcaaaatctctgccagtctgacagggggttctagagtgaaaacacatccattaaagcagtcaggctgtggtcctctgtcatctcagtcattggtgcggggctgctaagaagagaacggtttttgactcaaaagctgaacgcaccaacttctagaggccaccttcactgtgacagaaactgcatgtttaaatactatactaacaatttataactatccggtggcttaatcaactttttattgagtttctgttgctgagaataagtcatcttttatgcgtattattacggctagtgaacactttttcttgaggtcaaagggatggtccaacatgactttaaaatatactaggacttggcacagtgtctaaaacaagtgcttggtgaatgtaaattattagtagtagttgcagtaataaccaatagtaatattccaactatcttacaccttccaaaccaaggagagattattatgttttatgtatctcttgaacaccagactcatttctagtgtactttgaagtgcccaaagattatagacacacaaatatgtctaacagaataattacagtattttttaaggagtataaaatctgtatcctcaaatattggtaatcaacaggataatcttcgtacagtggtttctgtgagcaggagataatgtctgctctactagttgcccaaatatcgcctaagtattctctttgcctaggaacacagaatgaaagcttgcatctcttgctgactttctttgccaccacagtgtcagcattttgtgtttaaaagcctatttcaggtcttgtaacatagaataaagtgactaataccttgatcctaataagattgacctatacttttagagtgtcatgaattaaactaaaaatctcaggaactatctctctctttctctctttctctctctctctctctctctctctcacacacacacacacacacacacacacacacacacaacaaacaaataaaaaacacacattttgacttgaagttttactttagcaatagacttgccaggactttcccaaccaaaagatatcaataaggttcctaacattttctaagatttaagtatcccatgctcaatttgttaaataacacattttaaaaactttattgaaatgactatatttttaaagctatgtgcattgttgtctgtttcatcaacattgacatagcagaaacaagagtactctctgctaaatagagaagaatgattaagttggagccaagtgagacaaagttatctccctctgcctacctcacaattcaaggttcccacctagggaactgatgcatccctgggtgattggacacaacatgggatcaattcagcctctactctgcctatgatttgatcaaatcatattagcaaagtgtctcttaaacatccatatatgaatattaaagagtattaaggggggcatttcttaacaatatttttatgagtatagttataagtttctaaacatttataatacgatgactaaaatatgctatttttaaattcaagtgttaaccttgccacacagaattatgacttctagggtgtaaactttaaagtgaaactgttttgaaaaaaatctgcagttaagtgtatgtgtatatatagaagaaaaggaaacttagatttactggtatcaccagtgaagcaagaatgcttagaaagatacaaatgtgtctttgggagagtctgcttaatcagatgcttaaagtaagacaagtctctgcatgagacttagaaatctcctaggagcagctggattccacactgagactcaacagagttctgggctatgctgtattttggaaaaggaaaagcgggtgctgagagctaagtagccaattactctttatagccacataaggactgaaggcaagtaggcccttccaacaagttgtattatgcgatcactggctttgcagggaatctcacgaatgtataaccttctgattgcctttttgattgaaagttccatctgagatcagggcagtgtaaccagtaataagatttcaaaaaaatcccatcactggcactgtcggaaaggctgagcatgactgaaatcctatcattgtcagtcaaaaagataaggtaacagcgggcatcactataaaagctctataaatgcacaacttaaacatgaatatcaacattaaaaagaatatatatatccttatacatatatttataaatatattcatatatataaatatgcacatatatacacaattcagttactggggataatttatagttttaatttttcatctcataatctcacgcactgccaacaaattgaaattgtggctctctgttttcatgaatctaaccttgaatttgaaagaagttgaattgagggtaaagggttttaaaagcagctttttatttgtgaacagaataatggctcataatacctgggattagaattaaatatgtcacgttgtgaggctgtacttagactttttaaatgtcattgtatttttttgtggacaaaataattgtagaatatactttgcaggaaatacttttctatattttttcaatttcaatactgttttatttgctataaaaagtgtctttgcactgttactcagccaaacagtgttgaatgtattatttgcccttgtaattattgcttcttatgataattgtagaagagcatgtctttatgatctatcatttaaaaatacatttattgtcattgtagttttagtcaacacaaatttatggattacatggtatactgttgctattgaagatattctagtcctagtattttgagcacagacctagcgttatggaggacataaaatttaaaaatttcctgacttgatggactatctgaggaaaaagaattttgtctgtcacatttattgagtatctatcagtacagaaattaagctacatggttgatacagaaagattaaatacagtagcattctcaaacttattttctttatttataaaatgtacctaatcaatctcataagaactaattgttgaattttttttttatctatggataaatactatttgagtctgggtttaagtttggttgatctgacactaaatccccttaactttcaactaaacagttatctctgtaattatgagacttttgatgataagaaatagaaactaagttatatatagtgctatggaagtactgaggaggaagtaagggaccccatatgggaagactcaagaagacgtcacggtgaaattttccaaaaagatgggaactcaagaatgggtgcaacagaaatcacagcttttccaaatactaaaagggaaaattataaaaagcaccaatggcacacttttggacattcagaaagatccagaaattaggtgcttataggaaactctaggtttgccaaattgtagtgttttatggataggaaaaatgaagttcagaaacgttataaggaattttcagggttaaattacacatcaaatatgtgagagaaacagaaattacatgctggtatttggggtcatctcctgagttgtaatgttgtaagtgtttttgtatgtattctcctccttcctttatgtgtggaagtttcatctaggtctcaaggttagtaggcatttgctggtgaaaatagtgcctttgggtactatttccccaacttgagttacctgccaccatctaattcacatcttgaatgcaagtattatttcttgcaagtatccctactaatagataatagatatttctattattatccacagattacagaagagggttgctaggaggaatatcacaagatgctgtctgaagagaaagactgtggaaaaccatggcttcaatgaactcagaggtcaggaccagaaaaggaaatgagaggtcaccaaagccaaatgttaatttcttgggatttcttctgtacatgcaaagaacttcaggccatcctatgattcctcaaaaataagaggaaaattttaacaattatgctctaagatggaccatgacaatttaggagtcattgggatcaccccccaaagccaaatgttaatttcttgggatttcttctgtacatgcaaagaacttcaggccatcctatgatccctcacaaataagaggaagattttaacaattatgctctaagatggaacatgacaatttaggagtcactgggatcaccccccccacctttccaacgttactctgctttaactacaaatatgtcgaatggttttctaatttttctttaacttaacctctaaagttcgagagctgtcatctttgtcaagtctgattgttgagtatgtgaatggatgtttttggctcaatgttagagccaaaatttataaataataattatttatacataatgatattgcaaataaactttaagaaagagctttaaacataaaaa

SEQ ID NO: 112858 - DNA, 3986 bp, Homo sapiens
  Payload ID: 2083
  Gene Symbol: CDH8
  Gene Name: cadherin 8, type 2
  ENST ID: ENST00000584337
  CDS Start-End: 523-2121
ggagcgctcagcccagaattagtggatttatttggaatctccctgcctcctccaagctccgccgccgccgccggcttgtgcatagacggtagcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtaaatatctccatgttgttaatgctgaatatgtttgtatacaactgtctcatatttgactaacctgcattatattgtgcatttgcatcatttatgatctgcaaagtctcaggcaagaaacacatccaaatgggaacagagagggaattttttttctccatcagatgttatttctcttcctacttatgaccaaattggctcctaaagtggaacaacctgctgtgccacaaacccagagccaaatcactgtcttaaaatatcttgggatatggatgatagcaggagatgtcttagagtgacgggggctgaatttttactttcaaatgacaagaagcaaggtaaaacctcgtggagaggagacatttgtttcacagcaaacatatgaataccaaataatagtgaaacccaagaaggccagtggtttatagaaagttgtaggaagtgaatattgaaatctgtaaatatgtaaatatatttagataaacataagatgaacaacacgttttacatgtgtgtattagtagaacattttttgtgcctcatattgcatagatgggtcaatgaaaacagaaaaaaaagaaacataaagaaagtgagagagagggagaaggaaagggagagggagagggaatgggaatgggagtgggaggaagggagggagggagagagaaaaagagggaggaagaaagggaggaaaatagttaaacaagcaagatgaacagaaacaaatatctgctatactctgaatgtcaaaatggaaatagcctgtgtaaagttctgcaaaaccataaatgtaatagatttattttaacaaggtaccaaagtactgtatgtttaagaaatttatcatttttcaacttcctaatttatttctggatggtgacattttaatttaaataaacagcagctgacagtatgacactggagttgttaatccaactattcttgtgcctcatgtgggtgttaggaattaaacttactatttgctaagcagcttacctgacaagagtcagattttttccccctaaagaaaggactggcactgtagctgtatgctttattataaatgatcaatttgttaccctcctataaaacagtgggcatttctccgtagactactctcatgtatctggagaattagcattgtttccatctaccagaataagacacaccacaccacacacacacacacgcacacacacacacacgttaaagctaaaattctaataataaaactgattaacttttaaacatctagccatgttctcatcaaagcattcagctttagtagagatataggtttatttttataatattctaacattagcttaaatgtttcctaattttatcatgtggaattaccccctatcaatcacacgttttgagcatcttcatttgtgatcctttgagaagggagtgtgtatatgtttatatatacacatatcaatacatatcatttacctaaattggtagattgagttgtcagagagagtttgatcaaaatatggcaggttgtttcaaagatatggttgttgtgtggaccagatcattgctgagataatgtagccaaatcacagactggtaagctagactttttcaatcacatagagtctgtaaaatacttcagaatttaaataaaactccattgctcatgcaaaactcatcagataagttcaaggagtcaatgacattgatatttcaaaaactcaacattggcttcacttgcgttattgacaagcatgtttcttggatctctgggaatttgtaggtttgccctgtggattttgactgttttcaaagttctaatgatttctcagtcgttcttcttaacttcagaaaaaaaaatgcattgttttctcatctttcctatgcaaaaccaaaataaaaaattgattctttgttttatgatttttgcaaatcacaatgaa

SEQ ID NO: 112859 - DNA, 3079 bp, Homo sapiens
  Payload ID: 2084
  Gene Symbol: CDH9
  Gene Name: cadherin 9, type 2 (T1-cadherin)
  Uniprot ID: Q9ULB4
  ENST ID: ENST00000231021
  CDS Start-End: 174-2543
actgagatgcatgaagattcagctgtgaagatactataaaaagggaagagaaggaccgagacagaagcaacaacggaactgtcagtgcggagtagggctaaactcagttccattgttaagcaaggaaaaacaaacaatacattgaatttgacaacccactgaagttgcagataatgaggacttaccattatataccattattcatctggacctatatgttccatacagttgacaccatcctattacaagaaaaacctaacagttatttatcaagcaaaaagatagcgggtctgacaaaagatgacggtaaaatgctacgtcgcaccaagcgtggctggatgtggaatcagttcttcttattggaagagtacacaggtactgacacacaatatgtaggcaagcttcacactgaccaagataaaggagatggaaatttaaaatacatactaacaggagatggggctggcagtctatttgttatagatgaaaatacaggagacattcatgctgcaaagaaactagacagagaagaaaaatctctgtacattcttcgtgccaaggctatagacagaaaaactgggcggcaggtggaaccggaatcggaatttatcattaaaatacatgatatcaatgacaatgagccaaaatttacaaaagacttatacactgccagtgttcctgaaatgtctggagtcggtacatctgttatacaagtaactgcaacagatgcagatgacgccaactatggaaatagtgccaaagtggtctatagcatattgcaaggacagccatatttttcagtggacccagaatcaggcataataaaaactgcattaccagacatgagcagagaaaatagagagcagtaccaggttgttatacaggccaaagacatgggtggccagatgggaggcctttctggaaccaccacagtgaacatcacgctgacagatgtcaacaacaaccctcctcgatttccccagagtacgtatcaatttaattctcctgagtctgtacctcttggaactcatcttggaaggataaaagccaatgaccctgacgtgggggaaaatgcagaaatggagtatagcattgctgaaggagatggtgcagacatgttcgatgtcatcactgacaaggatacacaggaagggattataactgtcaaacagaatttagattttgaaaatcaaatgctctatactttaagagtggatgcaagtaacactcaccctgatccacgattcttacacctgggacctttcaaagatacagctgtggtcaaaatatctgtggaagatatagatgagcctcctgtgttcactaaagtctcttacttgatagaagtagatgaagatgtaaaggagggcagtatcattggacaggttacagcatacgatccagatgccaggaacaatttaataaagtactctgttgatcggcatactgatatggaccgtatttttggtattcactcagaaaatggttctattttcactttgaaagcccttgaccgggaatcatctccttggcataacatcactgttacagccacagaaataaataacccaaaacaaagtagccacatccctgtcttcatcagaattctagatataaatgaccatgctccggaatttgccatgtattatgaaacatttgtttgtgaaaatgcaaaacctgggcagttgattcagactgtcagtgtcatggataaggatgaccctccccgaggtcacaaattcttttttgaaccagtgccagaatttactctcaatccgaatttcaccattgtagataataaagataatacagcaggaatcatgactcggaaagatggctacagtcgcaacaaaatgagcacctacttattgccgattttaatctttgacaacgattatccaattcaaagcagcactggtacactcactatccgtgtgtgtgcctgcgataatcaaggaaacatgcaatcctgcaccgcagaagccctgatcctttcagccggcctgagcacgggagctctcgttgcgattctactctgtgtcctcatactgcttattttagtcgtgttgtttgctgcattgaagaggcaaagaaaaaaggaacctctgataatttcaaaagacgatgtccgggacaacattgtgacctacaacgatgaaggcggcggggaagaagatacccaagcttttgacattggcacattaaggaatccagaggcaagagaagacagtaaacttagacgggatgtaatgcctgaaactatttttcagataaggaggactgtgcctctgtgggaaaatattgatgtacaagattttatccatcgaagattaaaagaaaacgacgcagacccaagtgcacctccatatgattcgctggcaacgtatgcctatgaagggaatgattccatagcagattcgctcagttctttggaatctctcacagctgattgtaaccaagattatgattacctcagtgactgggggcctcgtttcaaaaaacttgccgatatgtatgggggtgatgatagtgaccgagactaagaggattgtttgacttaatcaatattagtggaagtactgtctatgttattagattgagtggcctgcattctcttcctgggaggaaatctttcaaaaattgaagttacaaacaatacgtagatgttgtcaagtagggatttgcttaatcagtaagtctttgtgaatgaatacgaatgatacagatttttaaaaaagtaataaccagttcaccctctttgcctaacaatctcggaaggaaaatatatcacatcaataatcaataaaaataagtaaaaggctttttgtgccttttcttaggtataataatttataaatgttttcttaactgactttcagtcacctttacaattaaactaaatattgtgcaaccgctttgtaaattaatatgaagaagatatatccctaatgaaataggaatgactattactgccatatttatttagttgaagaatgtctttgtgttaattcattcatatttttataaatgtatatttatatttttgtatttttatgaaataaactagtatttataaaac

SEQ ID NO: 112860 - DNA, 532 bp, Homo sapiens
  Payload ID: 2084
  Gene Symbol: CDH9
  Gene Name: cadherin 9, type 2 (T1-cadherin)
  ENST ID: ENST00000511822
  CDS Start-End: 288-532
gagatgcatgaagattcagctgtgaagatactataaaaagggaagagaaggaccgagacagaagcaacaacggaactgtcagtgcggagtagggctaaactcagttccattgttaagcaaggtctcattctgtcgcccaggctggagtgtagtggcaggatcttggctcactgcaacgtctgcctcttgggttcaagtgattattgtgattcaacctcccaagtatctgggactacaggaaaaacaaacaatacattgaatttgacaacccactgaagttgcagataatgaggacttaccattatataccattattcatctggacctatatgttccatacagttgacaccatcctattacaagaaaaacctaacagttatttatcaagcaaaaagatagcgggtctgacaaaagatgacggtaaaatgctacgtcgcaccaagcgtggctggatgtggaatcagttcttcttattggaagagtacacaggtactgacacacaatatgtaggcaagcttcacactgaccaaga

SEQ ID NO: 112861 - DNA, 556 bp, Homo sapiens
  Payload ID: 2084
  Gene Symbol: CDH9
  Gene Name: cadherin 9, type 2 (T1-cadherin)
  ENST ID: ENST00000513289
  CDS Start-End: 159-556
agacttaactggggaagcctctattgtccctagcatttaccctattgtgtccggaattggtgggttcttggtctcactgacttcaagaacgaagccgcgcaccctcacggaaaaacaaacaatacattgaatttgacaacccactgaagttgcagataatgaggacttaccattatataccattattcatctggacctatatgttccatacagttgacaccatcctattacaagaaaaacctaacagttatttatcaagcaaaaagatagcgggtctgacaaaagatgacggtaaaatgctacgtcgcaccaagcgtggctggatgtggaatcagttcttcttattggaagagtacacaggtactgacacacaatatgtaggcaagcttcacactgaccaagataaaggagatggaaatttaaaatacatactaacaggagatggggctggcagtctatttgttatagatgaaaatacaggagacattcatgctgcaaagaaactagacagagaagaaaaatctctgtacattcttcgtgccaaggctatagacag

SEQ ID NO: 112862 - DNA, 11389 bp, Homo sapiens
  Payload ID: 2085
  Gene Symbol: CELSR1
  Gene Name: cadherin, EGF LAG seven-pass G-type receptor 1
  Uniprot ID: Q9NYQ6
  ENST ID: ENST00000262738
  CDS Start-End: 1-9045
atggcgccgccgccgccgcccgtgctgcccgtgctgctgctcctggccgccgccgccgccctgccggcgatggggctgcgagcggccgcctgggagccgcgcgtacccggcgggacccgcgccttcgccctccggcccggctgtacctacgcggtgggcgccgcttgcacgccccgggcgccgcgggagctgctggacgtgggccgcgatgggcggctggcaggacgtcggcgcgtctcgggcgcggggcgcccgctgccgctgcaagtccgcttggtggcccgcagtgccccgacggcgctgagccgccgcctgcgggcgcgcacgcaccttcccggctgcggagcccgtgcccggctctgcggaaccggtgcccggctctgcggggcgctctgcttccccgtccccggcggctgcgcggccgcgcagcattcggcgctcgcagctccgaccaccttacccgcctgccgctgcccgccgcgccccaggccccgctgtcccggccgtcccatctgcctgccgccgggcggctcggtccgcctgcgtctgctgtgcgccctgcggcgcgcggctggcgccgtccgggtgggactggcgctggaggccgccaccgcggggacgccctccgcgtcgccatccccatcgccgcccctgccgccgaacttgcccgaagcccgggcggggccggcgcgacgggcccggcggggcacgagcggcagagggagcctgaagtttccgatgcccaactaccaggtggcgttgtttgagaacgaaccggcgggcaccctcatcctccagctgcacgcgcactacaccatcgagggcgaggaggagcgcgtgagctattacatggaggggctgttcgacgagcgctcccggggctacttccgaatcgactctgccacgggcgccgtgagcacggacagcgtactggaccgcgagaccaaggagacgcacgtcctcagggtgaaagccgtggactacagtacgccgccgcgctcggccaccacctacatcactgtcttggtcaaagacaccaacgaccacagcccggtcttcgagcagtcggagtaccgcgagcgcgtgcgggagaacctggaggtgggctacgaggtgctgaccatccgcgccagcgaccgcgactcgcccatcaacgccaacttgcgttaccgcgtgttggggggcgcgtgggacgtcttccagctcaacgagagctctggcgtggtgagcacacgggcggtgctggaccgggaggaggcggccgagtaccagctcctggtggaggccaacgaccaggggcgcaatccgggcccgctcagtgccacggccaccgtgtacatcgaggtggaggacgagaacgacaactacccccagttcagcgagcagaactacgtggtccaggtgcccgaggacgtggggctcaacacggctgtgctgcgagtgcaggccacggaccgggaccagggccagaacgcggccattcactacagcatcctcagcgggaacgtggccggccagttctacctgcactcgctgagcgggatcctggatgtgatcaaccccttggatttcgaggatgtccagaaatactcgctgagcattaaggcccaggatgggggccggcccccgctcatcaattcttcaggggtggtgtctgtgcaggtgctggatgtcaacgacaacgagcctatctttgtgagcagccccttccaggccacggtgctggagaatgtgcccctgggctaccccgtggtgcacattcaggcggtggacgcggactctggagagaacgcccggctgcactatcgcctggtggacacggcctccacctttctggggggcggcagcgctgggcctaagaatcctgcccccacccctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcccgcatcacctacgtgattcaggaccccgtgccgcagttccgcattgaccccgacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctgatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactggagagcactgtgaggtggatgcccgctcaggccgctgtgccaacggggtgtgcaagaacgggggcacctgcgtgaacctgctcatcggcggcttccactgcgtgtgtcctcctggcgagtatgagaggccctactgtgaggtgaccaccaggagcttcccgccccagtccttcgtcaccttccggggcctgagacagcgcttccacttcaccatctccctcacgtttgccactcaggaaaggaacggcttgcttctctacaacggccgcttcaatgagaagcacgacttcatcgccctggagatcgtggacgagcaggtgcagctcaccttctctgcaggcgagacaacaacgaccgtggcaccgaaggttcccagtggtgtgagtgacgggcggtggcactctgtgcaggtgcagtactacaacaagcccaatattggccacctgggcctgccccatgggccgtccggggaaaagatggccgtggtgacagtggatgattgtgacacaaccatggctgtgcgctttggaaaggacatcgggaactacagctgcgctgcccagggcactcagaccggctccaagaagtccctggatctgaccggccctctactcctggggggtgtccccaacctgccagaagacttcccagtgcacaaccggcagttcgtgggctgcatgcggaacctgtcagtcgacggcaaaaatgtggacatggccggattcatcgccaacaatggcacccgggaaggctgcgctgctcggaggaacttctgcgatgggaggcggtgtcagaatggaggcacctgtgtcaacaggtggaatatgtatctgtgtgagtgtccactccgattcggcgggaagaactgtgagcaagccatgcctcacccccagctcttcagcggtgagagcgtcgtgtcctggagtgacctgaacatcatcatctctgtgccctggtacctggggctcatgttccggacccggaaggaggacagcgttctgatggaggccaccagtggtgggcccaccagctttcgcctccagatcctgaacaactacctccagtttgaggtgtcccacggcccctccgatgtggagtccgtgatgctgtccgggttgcgggtgaccgacggggagtggcaccacctgctgatcgagctgaagaatgttaaggaggacagtgagatgaagcacctggtcaccatgaccttggactatgggatggaccagaacaaggcagatatcgggggcatgcttcccgggctgacggtaaggagcgtggtggtcggaggcgcctctgaagacaaggtctccgtgcgccgtggattccgaggctgcatgcagggagtgaggatgggggggacgcccaccaacgtcgccaccctgaacatgaacaacgcactcaaggtcagggtgaaggacggctgtgatgtggacgacccctgtacctcgagcccctgtccccccaatagccgctgccacgacgcctgggaggactacagctgcgtctgtgacaaagggtaccttggaataaactgtgtggatgcctgtcacctgaacccctgcgagaacatgggggcctgcgtgcgctcccccggctccccgcagggctacgtgtgcgagtgtgggcccagtcactacgggccgtactgtgagaacaaactcgaccttccgtgccccagaggctggtgggggaaccccgtctgtggaccctgccactgtgccgtcagcaaaggctttgatcccgactgtaataagaccaacggccagtgccaatgcaaggagaattactacaagctcctagcccaggacacctgtctgccctgcgactgcttcccccatggctcccacagccgcacttgcgacatggccaccgggcagtgtgcctgcaagcccggcgtcatcggccgccagtgcaaccgctgcgacaacccgtttgccgaggtcaccacgctcggctgtgaagtgatctacaatggctgtcccaaagcatttgaggccggcatctggtggccacagaccaagttcgggcagccggctgcggtgccatgccctaagggatccgttggaaatgcggtccgacactgcagcggggagaagggctggctgcccccagagctctttaactgtaccaccatctccttcgtggacctcagggccatgaatgagaagctgagccgcaatgagacgcaggtggacggcgccagggccctgcagctggtgagggcgctgcgcagtgctacacagcacacgggcacgctctttggcaatgacgtgcgcacggcctaccagctgctgggccacgtccttcagcacgagagctggcagcagggcttcgacctggcagccacgcaggacgccgactttcacgaggacgtcatccactcgggcagcgccctcctggccccagccaccagggcggcgtgggagcagatccagcggagcgagggcggcacggcacagctgctccggcgcctcgagggctacttcagcaacgtggcacgcaacgtgcggcggacgtacctgcggcccttcgtcatcgtcaccgccaacatgattcttgctgtcgacatctttgacaagttcaactttacgggagccagggtcccgcgattcgacaccatccatgaagagttccccagggagctggagtcctccgtctccttcccagccgacttcttcagaccacctgaagaaaaagaaggccccctgctgaggccggctggccggaggaccaccccgcagaccacgcgcccggggcctggcaccgagagggaggccccgatcagcaggcggaggcgacaccctgatgacgctggccagttcgccgtcgctctggtcatcatttaccgcaccctggggcagctcctgcccgagcgctacgaccccgaccgtcgcagcctccggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggccgttggtgggacgggagggtggtctgcccggggctgcgagctcctgtccaggaaccggacacatgtcgcctgccagtgcagccacacagccagctttgcggtgctcatggatatctccaggcgtgagaacggggaggtcctgcctctgaagattgtcacctatgccgctgtgtccttgtcactggcagccctgctggtggccttcgtcctcctgagcctggtccgcatgctgcgctccaacctgcacagcattcacaagcacctcgccgtggcgctcttcctctctcagctggtgttcgtgattgggatcaaccagacggaaaacccgtttctgtgcacagtggttgccatcctcctccactacatctacatgagcacctttgcctggaccctcgtggagagcctgcatgtctaccgcatgctgaccgaggtgcgcaacatcgacacggggcccatgcggttctactacgtcgtgggctggggcatcccggccattgtcacaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgagaaaccgtgaggcaagcccgtcaccccacacaggctgcggcatcaccctcagaccttggagcccaaggggccactgcccttgaagtggagtgggcccagagtgtggcggtccccatggtggcagccccccgactgatcatccagacacaaaggtcttggttctcccaggagctcagggcctgtcagacctggtgacaagtgccaaaggccacaggcatgagggaggcgtggaccactgggccagcaccgctgagtcctaagactgcagtcaaagccagaactgagaggggaccccagactgggcccagaggctggccagagttcaggaacgccgggcacagaccaaagaccgcggtccagccccgcccaggcgggcatctcatggcagtgcggacccgtggctggcagcccgggcagtcctttgcaaaggcaccccttgtcttaaaatcacttcgctatgtgggaaaggtggagatacttttatatatttgtatgggactctgaggaggtgcaacctgtatatatattgcattcgtgctgactttgttatcccgagagatccatgcaatgatctcttgctgtcttctctgtcaagattgcacagttgtacttgaatctggcatgtgttgacgaaactggtgccccagcagatcaaaggtgggaaatacgtcagcagtggggctaaaaccaagcggctagaagccctacagctgccttcggccaggaagtgaggatggtgtgggccctccccgccggccccctgggtccccagtgttcgctgtgtgtgcgtttgtcctctgctgccatctgccccggctgtgtgaattcaagacagggcagtgcagcactaggcaggtgtgaggagccctgctgaggtcactgtggggcacggttgccacacggctgtcatttttcacctggtcattctgtgaccaccaccccctcccctcaccgcctcccaggtggcccgggagctgcaggtggggatggctttgtcctttgctcctgctccccgtgggacctgggaccttaaagcgttgcaggttcctgatttggacagaggtgtggggccttccaggccgttacatacctcctgccaattctctaactctctgagactgcgaggatctccaggcagggttctcccctctggagtctgaccaattacttcattttgcttcaaatggccaattgtgcagagggacaaagccacagccacactcttcaacggttaccaaactgtttttggaaattcacaccaaggtcgggcccactgcaggcagctggcacagcgtggcccgaggggctgtggaacgggtcccggaactgtcagacatgtttgattttagcgtttcctttgttcttcaaatcaggtgcccaaataagtgatcagcacagctgcttccaaataggagaaaccataaaataggatgaaaatcaagtaaaatgcaaagatgtccacactgttttaaacttgaccctgatgaaaatgtgagcactgttagcagatgcctatgggagaggaaaagcgtatctgaaaatggtccaggacaggaggatgaaatgagatcccagagtcctcacacctgaatgaattatacatgtgccttaccaggtgagtggtctttcgaagataaaaaactctagtccctttaaacgtttgcccctggcgtttcctaagtacgaaaaggtttttaagtcttcgaacagtctcctttcatgactttaacaggattctgccccctgaggtgtaatttttttgttctatttttttccacgtactccacagccaacatcacgaggtgtaatttttaatttgatcagaactgttaccaaaaaacaactgtcagttttattgagatgggaaaaatgtaaacctatttttattacttaagactttatgggagagattagacactggaggtttttaacagaacgtgtatttattaatgttcaaaacactggaattacaaatgagaagagtctacaataaattaagatttttgaatttgtacttctgcggtgctggtttttctccacaaacacccccgcccctccccatgcccagggtggccgtggaagggacggtttacggacgtgcagctgagctgtccgtgtcccatgctccctcagccagtggaacgtgccggaactttttgtccattccctagtaggcctgccacagcctagatgggcagtttttgtctttcaccaaatttgaggactttttttttttgccattatttcttcagttttcttttcttgcactgatctttctcctctccttctgtgactccagtgactcagacgttagacctcttgatgttttcccactggtccctgaggctctgttc

SEQ ID NO: 112863 - DNA, 2446 bp, Homo sapiens
  Payload ID: 2085
  Gene Symbol: CELSR1
  Gene Name: cadherin, EGF LAG seven-pass G-type receptor 1
  ENST ID: ENST00000454637
  CDS Start-End: 1-2318
ctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcccgcatcacctacgtgattcaggaccccgtgccgcagttccgcattgaccccgacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctgatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactgaaatttcgtgactcatcctcccgcctctgaagatgctctttccttgatacctcctgactcatcaccaagatgaattactccaaatgtagccaacggtggtttttaaaaataaagagccaccccgagagcggtacagaaa

SEQ ID NO: 112864 - DNA, 10534 bp, Homo sapiens
  Payload ID: 2086
  Gene Symbol: CELSR2
  Gene Name: cadherin, EGF LAG seven-pass G-type receptor 2
  Uniprot ID: Q9HCU4
  ENST ID: ENST00000271332
  CDS Start-End: 62-8833
aggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagtgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactatgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtctttcagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcccggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccggagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggaggcccccctccccgcccaccgccccggcagagcctccaggagcagctgaacggggtcatgcccatcgccatgagcatcaaggcaggcacggtggatgaggactcgtcaggctccgaatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgcctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgtgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctcccccgtcttctcccctcagcaattcctgcaaagggttaaaaatttaactggtttttactactgatgacttgatttaaaaaaaatacaaagatgctggatgctaacttggtactaaccatcagattgtacagtttggttgttgctgtaaatagggtagcgttttgttgttgttgttttttcatgccccatactactgaataaactagttctgtgcgggt

SEQ ID NO: 112865 - DNA, 11956 bp, Homo sapiens
  Payload ID: 2087
  Gene Symbol: CELSR3
  Gene Name: cadherin, EGF LAG seven-pass G-type receptor 3
  Uniprot ID: Q9NYQ7
  ENST ID: ENST00000164024
  CDS Start-End: 282-10220
agcgaaccatcggggcggccgggagccatgttggagcggcgggaggcggcagcagcgtcggggatgctgtggtgggggcggaaaaagccagggccgcacgccggaggggctccggccgcggagtagatggtgcccagagggcggcgggggtgcggagagacaggcggaggggcgggggcccggggcggcggcaggggcccgggagggggcccgagcggcggggccagcccaaggcccggaccggggcggggggcggtggaggccgtgcagggaggcgggggatgatggcgaggcggccgccgtggcggggcctcgggggacggtcgacccccatactcctgctccttctcctctctttgttccccctcagccaggaggagctggggggcggtgggcaccagggctgggacccaggcttagctgccactacggggccaagggcgcatatcggtggcggagccttagctctttgtccggagtcttccggggtccgggaggatggggggcctggcctgggggtcagggagcctatcttcgtggggctccgagggagaaggcaaagcgcccggaatagtcgagggccccctgagcagccgaatgaggagctggggattgaacacggcgtccagccattgggcagccgcgaacgagagacaggacagggaccagggtctgtgttatactggcgcccagaggtctcctcttgcgggcggacaggacctttgcaaagaggtagtctgtcaccaggggctctgtcctcaggggtcccgggctcggggaacagctcgcccctcccttcagactttttgattcggcaccacggtcccaagccggtgtcctcccagcggaacgctgggacaggctcccgcaaaagagtgggcaccgcgcgctgctgtggggaattatgggcaacagggagcaagggtcagggcgagagagccacgacatccggagcagaaaggacagccccccggcggaactgtcttccaggggcctcgggatctggccccgagctggattcagcaccacgcacggcgaggacagctcctgcatcaggttcagcaccccgcgagtctcggacagctcccgagccggcgcccaagcgcatgcgctcccggggtctcttccgctgccgcttcctcccgcagcgccccgggccgcgtcccccgggactcccggcccgtcctgaagccaggaaagtaacctcggcgaaccgggcacgctttcgtcgcgccgcaaaccgccacccgcagtttccgcagtacaactaccagacgctggtgccggagaatgaggcagcaggcaccgcggtgctacgcgtggttgctcaggacccggacgccggcgaggccgggcgcctagtctactcgctggcggcactcatgaacagccgctcgctggagctgttcagcatcgacccgcagagcggccttatccgtacggcggcagctctggaccgcgagagcatggagcgtcactacctgcgtgtgaccgcgcaggaccacgggtcgccgcgcctctcggccaccacgatggtggccgtgacagtagccgaccgcaacgaccactcgccggtttttgagcaagcgcagtaccgggagacccttcgcgagaatgtggaggagggctaccctatcctgcagctgcgtgccactgacggcgacgcgccccccaacgccaacctgcgctaccgcttcgtggggccgccagctgcgcgcgctgcagctgccgccgccttcgagattgatccacgctccggcctcatcagcaccagcggccgagtggaccgcgagcacatggaaagctatgagctggtggtggaagccagcgaccagggccaggaacccgggccgcgctcggccactgtgcgcgtacacataactgtgctagacgagaacgacaatgctcctcagttcagcgagaagcgctacgtggcgcaggtgcgcgaggatgtgcgcccccacacagtcgtgctgcgcgtcacggccactgaccgggacaaggacgccaacggattggtgcactacaacatcatcagtggcaatagccgtggacactttgccatcgacagcctcactggcgagatccaggtggtggcacctctggacttcgaggcagagagagagtatgccttgcgcatcagggcgcaggatgctggccggccaccgctgtccaacaacacgggcctggccagcatccaggtggtggacatcaatgaccacattcctatttttgtcagcacgcccttccaagtttctgtcttggaaaatgctcccttgggtcactcagtcatccacattcaggcagtcgatgcagaccatggggagaatgccagattggagtactccctaactggtgtggcacctgatactccttttgtgataaacagcgccactggctgggtctctgtgagtggtcccctggaccgtgagtctgtggagcattacttctttggtgtggaggctcgagaccatggctcacccccactctctgcctcagccagtgtcaccgtgactgtgctggacgttaatgacaatcggcctgagttcacaatgaaggagtaccacctacgactgaatgaggatgcagctgtgggcaccagtgtggtcagcgtgaccgcagtagaccgtgatgccaacagtgccatcagctaccagatcacaggcggcaacacccggaatcgctttgccatcagcacccaggggggtgtgggtctggtgactctggctctgccactggactacaagcaggaacgctacttcaagctggtactaactgcatctgaccgtgcccttcatgatcactgctatgtgcacatcaacatcacagatgccaacactcatcggccggtctttcaaagtgcccactactcagtgagtgtgaatgaagatcggccaatgggtagcaccatagtggtcatcagtgcctctgatgatgacgtgggtgagaatgctcgtatcacctatctcctggaggacaacctgccccagttccgcattgatgcagactcaggagccattacattacaggccccattagactatgaggaccaggtgacctacaccctggctatcacagctcgggacaatggcatcccacagaaggcagacactacttatgtggaggtgatggtcaatgacgtgaatgacaatgctccacaatttgtggcctcccactatacagggctggtctctgaggatgccccacctttcaccagtgtcctgcagatctcagccactgaccgggatgctcatgccaatggccgggtccagtacactttccagaatggtgaagatggggatggagattttaccattgagcccacctctggaattgtccgtacagtaaggcggctagaccgggaggcagtatcagtgtatgagttgactgcctacgcagtggacagaggtgtgcccccactccggactccagtcagtatccaggtgatggtgcaggatgtgaacgacaatgcacctgtcttcccagctgaggagtttgaggtgcgggtgaaagagaatagcattgtgggctcagtggtggcccagatcactgcagtggaccctgacgaaggccccaatgcccatataatgtaccagatcgtggaggggaacatccctgagctgttccaaatggacatcttctctggagaactgacggcactcattgacctagactatgaggctcgccaagaatatgtgattgtggtgcaggccacatctgctcctttggtcagccgggccactgtgcacgtccgcctggttgaccagaatgacaacagccctgtgctcaacaacttccagatcctcttcaacaactatgtatccaaccgttcagacaccttcccgtcgggcattattgggcgcatcccagcttatgaccccgatgtctccgaccacctcttctactcctttgagcgtggcaatgagctgcagctgctggtagtcaaccagaccagtggggagctgcgactcagccgaaagctagacaataaccgcccactggtggcctccatgttggtgactgtcacagatggcctgcacagcgtgacggcgcagtgtgtgctgcgcgtggtcatcatcacggaggagttgctggccaacagcctgaccgtgcgccttgagaacatgtggcaggagcgcttcctgtcaccgctgctgggccgcttcctcgagggcgtggctgcggtgctcgctacgcccgctgaggacgtcttcatcttcaacatccagaacgacacagacgtagggggcaccgtgctcaatgtgagtttctcggcgctagctccacgtggggccggggcgggcgctgcagggccctggttcagctccgaggagctgcaggagcagttgtacgtgcgccgggcggcgctggcggctcgctccctgctcgacgtactgcccttcgacgacaacgtgtgcctgcgagagccctgtgagaactacatgaaatgcgtgtccgtgctccgctttgactcgtccgcgcccttcctggcctcggcctccacgctgttccgacccatccagcccatcgctggcctgcgctgccgctgcccgcccggattcacgggagacttttgcgagaccgagctcgacctctgctactccaacccatgtcgcaacggcggagcctgcgcgcggcgcgagggaggctacacgtgcgtctgccgcccgcgcttcaccggagaggactgcgagctggacaccgaggccggccgctgcgtgccgggcgtctgccgcaacgggggcacctgcaccgacgcgcccaacggcggctttcgctgccagtgcccggcaggcggcgccttcgagggcccgcgctgcgaggtggctgcgcgctccttcccgcccagttcgttcgtcatgtttcgcggcctgcggcagcgattccaccttacgctgtccctctcgttcgcgacagtgcagcagagcgggctgctcttctacaacgggcgcctgaacgagaagcacgacttcctggccctggaactcgtggctggccaagtgcggctcacatattccacgggtgaatccaacaccgtggtcagccccacagttccagggggcttgagtgacgggcaatggcatacagtgcatctgagatactacaacaagccccggacagatgccctagggggtgcacagggcccctccaaggacaaggtggctgtgctaagcgtggatgattgtgatgtggccgtggctctgcagtttggtgctgagattggcaactactcatgcgcggctgctggtgtgcaaacaagctccaagaagtccctggacctgacgggccctcttcttctgggaggtgtccccaacctccccgagaacttccccgtatcccataaggacttcatcggctgtatgcgggacctgcacattgatggccgccgagtggacatggcggcttttgtcgcaaataatggcaccatggcaggctgccaagccaagctacacttttgtgactcaggcccctgcaagaacagtggcttctgctcggagcgctggggcagcttcagctgcgactgccctgtgggcttcggcggcaaagactgtcagcttactatggcccatccccaccatttccgtggcaacggcacactgagctggaactttggaagtgacatggctgtgtctgtgccatggtacctggggctggcatttcggacacgggcaacgcagggggtcctgatgcaagtgcaggctgggccacacagcacgctcctttgccagctagatcgggggttactgtctgtgacagtgaccaggggctcgggccgtgcttcccatctccttctggaccaggtgactgtcagtgatggccggtggcacgatctgcggctggagttgcaggaggaaccaggtggccggcggggccaccatgtccttatggtctcactggactttagcctcttccaggacaccatggcggtggggagtgagctgcagggcctgaaggtaaagcagctccacgtgggaggcctgccccccggcagtgcagaggaggctcctcagggtctggttggctgcatccagggggtgtggctcggctccacaccctctggctccccggccctgctaccccccagccaccgagtgaatgcggagcctggctgtgttgtgaccaacgcctgtgcctctgggccctgcccacctcacgcagactgccgggacctctggcagaccttttcttgcacctgccagccaggttactacggcccaggctgtgtggatgcctgcctcctgaacccctgtcagaaccagggatcatgccggcacctgccaggagccccccatggctatacctgtgactgtgtgggtggctatttcgggcaccactgtgagcacaggatggaccagcagtgcccacggggctggtgggggagcccaacctgtggcccctgcaactgtgatgttcacaaaggttttgatcccaactgcaacaagacaaatgggcagtgtcactgcaaggagttccactaccgaccgcggggcagtgactcttgcctcccatgtgactgctaccctgtgggctccacctcgcgctcatgtgcaccccacagcgggcagtgcccctgtcgcccaggagcccttggccgccagtgcaacagctgtgacagtcccttcgcagaggtgacagccagcggctgccgggtgctctatgatgcctgccctaagtccctgagatctggtgtgtggtggccccagacaaagtttggcgtcctggccacagtgccctgtccccggggggccctgggtgctgctgtgcggctgtgtgatgaggcccagggttggctggagcccgacctcttcaactgtacctcccctgcctttcgagagctcagtctgctgctggatggcctagagctgaacaagacggcactggataccatggaggccaagaagctggctcagcggctacgggaggtgactggccacactgaccactattttagccaagatgttcgagtcactgcccgcctgctggcccacctgctggccttcgagagccatcagcagggcttcgggctgacagccacacaggatgcccacttcaatgagaatctgctgtgggccggctctgcactgcttgccccagagacaggggacttgtgggcggcgctggggcagcgggcccctgggggctccccaggcagcgcgggactggtgaggcacctggaggagtatgcagccacactcgcaaggaatatggaactcacatacctgaatcccatggggctggtgacgcctaatatcatgctcagcattgaccgcatggagcaccccagttctccccggggggcccgtcgctaccctcgctaccatagcaacctctttcgaggccaggatgcctgggatcctcacacccatgtgctgctgccttcccagtccccacggccatccccatctgaagttctgcccacaagcagcagcatagaaaactccaccacctcaagtgtggtccccccaccagccccgccagagccagagcctgggatctccattatcattctcctcgtttaccgcaccttagggggactgctccctgcccagttccaggcagaacgccgaggtgccaggcttcctcagaaccccgtcatgaactccccggtggtcagcgtggctgtgttccacggacgcaacttcctaaggggaatcctggagtcccccatcagcctagagtttcgcctgctacagacagcgaatcggagcaaggcgatctgtgtgcagtgggacccacctggcctggcggagcagcatggtgtgtggacagcacgggactgcgagctggtgcacaggaatgggtcccacgcacggtgtcgctgcagccggacagggacctttggggtcctcatggatgcctctccccgtgagaggctggagggcgacctggagctgctggctgtgttcacccacgtggtcgtggctgtgtctgtggctgcgctggtgctgactgcagccatcctgctgagcctgcgcagcctcaagtccaatgtgcgtgggatccatgccaatgtggcagccgccctgggggtggcagagctcctcttcctgctggggattcacaggacccacaatcagctggtgtgcactgcagtcgccatcctcctgcactacttcttcctcagcaccttcgcgtggctcttcgtgcaggggctgcacctctaccgcatgcaggttgagccacgcaacgtggaccgcggcgccatgcgcttctaccatgccctgggctggggcgtccctgctgtgctgctgggccttgctgtgggcctggaccctgagggctatgggaaccctgacttctgctggatctcagtccacgagcccctcatctggagctttgctggccctgttgtcctggtcatagtgatgaacgggaccatgtttctcctcgctgcccgcacatcctgctccacagggcagagggaggccaagaagacctctgcactgacccttcgcagctccttcctgctgcttctgctggtcagtgcctcctggctctttgggctcctggcagtcaaccacagcatcctagccttccactacctccatgctggactctgcggcctccagggcctggcggtgctgctgctcttctgtgtcctaaatgcagatgctcgggctgcctggatgccagcctgtctgggcaggaaggcagcgcctgaggaggcaaggccagcacctgggctgggacctggggcctacaacaacacggctctctttgaggagagtggcctcatccgcatcactctgggcgcctccaccgtctcctctgtgagcagtgcccgctccggccggacccaggaccaggacagccagcggggccgcagctacctcagggacaatgtcctggttcgacatggctcagccgctgaccacactgaccacagcctccaggctcatgctggccccactgacctggacgtggccatgttccatcgagatgctggcgcagactccgactctgacagtgacctgtccttggaggaggagaggagtctctccattccatcttcagaaagcgaggacaatggccggacgcgggggcgcttccaacggccactctgccgagcagcccagagtgagaggctcctcacccaccccaaagatgtggatggcaatgacctcctgtcctactggccagccctgggggagtgcgaggcagccccctgtgctctgcagacttggggctctgaaaggcgcctggggctggacaccagcaaggatgcagctaacaacaaccagccagacccggccctgaccagtggggatgagacttctctgggccgggcccagcgccagaggaaaggcatcctgaagaaccggttgcaatacccactggtgccacagacccgaggtgcccctgagctgtcctggtgccgtgcagccaccttgggccaccgtgctgtgccagctgcctcttacggtcgcatctatgctggcgggggcacgggcagcctttcacagccagccagccgctactcttctagagaacagctggacctgctcctccggcggcaactgagccgtgagcgactagaggaagcccctgcccctgttctacgtcccctgagccggccagggtcccaggaatgcatggatgctgcaccaggccgactggagcccaaagatcggggcagcaccctgccacggaggcagccacctcgggactaccctggcgccatggctggccgcttcgggtcacgggatgcgctcgacttaggggcacctcgagagtggttgagcacgctgcctccgccccgccgcacccgggaccttgacccacagcccccacctctgcccctgtctccccagcggcaactctcaagggaccccctcttgccatcccggccgctggactctctgtctaggagctcgaactctcgggagcagctggaccaggtgcctagccggcacccctcacgagaagcccttgggccactcccgcagctgctcagagctagggaggactcggtcagtggccccagccatggcccctccacagaacagttggacattctttcctccatccttgcctctttcaactcctcggccctctcctctgtgcaatcttcaagcacacccttgggccctcacaccactgccacaccttctgccacagcctctgtgcttgggccctccacgccacgttctgccacgtctcacagcatctcggagctgtcgccagactcagaagttcccagaagtgagggtcactcctgaggggatgacggcgtggacgaggaacagctgagggcgacagaggatctaggctaacaggagagactccaggagtgggggcagatcccaaggcagcctcctgctccccagtggtgggtgccccagctctacctggtgtggcagggctgaggctccatgtgcatctgtgagcatgcgtgtgacaggtgcagagacgggggactggagggagacttttatacgttttgtacctttgtaaccagagagatgcttatgttatttttcagcttttctgtctcctggggggtttgaggctgggctgggagggggagggagatagagggagagatgcagtttgaccccatttgggtcctgagcaaaccctatgctcatctctctctccttcctggggtggactcagatgggtgggacacatgccttcctccccctattccacccccaagttgatctgagtatcgtcaggggcccaaagtacagaattgttctttgctttttattgaatgctccaaaggccaaacttctggggctgggggttggtcttggaaacaggggtcctctgacttcctcatgggggcttgctcataccgcccctcctggtggatgtgtgtgtttattatgtggagtccctgccacttactgccttatgacctaggactgatgctgtggggtgctggtggagcagctgatgtcgtgtttacagagcaaggcttccctgtctcccacggggaggggctcgggcctctagtcagacattcctgcagagggtcggtggaggggtcattcacctgcccctgcagcaagcaaaagttgtctgtggtgccatttgattccctgacactgccccctgcttgaattgattccgaagggtagggtgggaaggtgagcaaagggagcagaaacaagggaattcaagacccagaatgtaggtgccactgcctcctatgtttacaggatcctccgtggccctaggcacctgggctgcaggaagtgactccgttccactcctcctttattcccttaaaaagggaaaaatgactgttacgaccctgttcacaaaactcttacttttgctattttgtctgctgtccagaactgaagactttaaaattttgttactgtttacaagtccagattcaaaaaatgtttttactttgtttacaactcaaaactttgagttttacactttgtttacagtagataattttttttcctttgtttccaagtgaaaggtagggaaagtgggagagggacttggaggacccacctgtgaggaccctgacctggccatcttgaggggttttctaacccccaggtctcccaggccgaaggtcagccttgagtcccgtttaacagcagatccagaagaccttgagagtaggcgtcctctaaccacgggggagagtggctgtgcagggctggggggtggtctgtgcagacacctcctcacccaccaccccatgcatactcttgggaagcagcttcctgggagattagaaattctacttccctgactggagctaaatcccaccagccaggacccaaactctccttaccgagaaggaccccagctcttgaagggctgagtggcctgctgggggtgggagggtgtctttactatgtcctaggtttcgtagatgcccctctctggggttcccctcctccagcccagcggccctctttcctgtctgtgtaaattgttccgtgaagccgcgctctgttttgggaataaacttctatag

SEQ ID NO: 112866 - DNA, 5340 bp, Homo sapiens
  Payload ID: 2088
  Gene Symbol: CPED1
  Gene Name: cadherin-like and PC-esterase domain containing 1
  Uniprot ID: A4D0V7
  ENST ID: ENST00000310396
  CDS Start-End: 468-3548
ctgcccggccccgggtggctgcgatgccgaggtcctctgctcccgccgggcgtgcagcgggcgcgcgcgcgtgtgtttatgtgtctgtgtgcgtgtgtgtgtgtgtctctctctgtgtgtgtgtgagatgaattggagtcatacgactgggtgtttccttccgagtggttttcatcagcaatccattaggaaatcatggaaactttttttttcctggctaaaaggatgaaaactgagtcatccacttttgactgtcatccatggaagagctcttattaaaagcctcagactttcgggacctatgattctttggcacaaccttttggaaaattcttaagcagggatgaagcaaacttgattggagttggggaaaaagaagacagattagtatttttcatgctgacaaaaaatagctgctatgacttttcccgcaacgtggacaggggccaagtgaagctgaactggtcatggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagattctgttcattggagattcaaccaacagagggatcatgtactatcttattgaaaggctgaatgaaacgttgcaggaatggcagaaagtacatggcactaaattctatcacaacgtcaatggtgggaagactttgatcagttattcctactatccccagttctggataagcccttcattgagaccaacatttgaaaatgcacttgaacacctcttgcaaagatcacgtcccctagagaatactggccagactgtattggttgttggtggtgttcagtggcttaattccaatcacctgcaaattattcacaaagttttgaagagggaaaatttactcaatatcctagtgatcatcaaaactttgggaattggatttcatctgccagtggatggagtacatttcttaacacagagtgaagtacagaacttatggaaagaaaatttgattattctggatactgcaaaaaaacatggctatgaagtagttgacacattcactataacaatggggcgttacaaagagtttctacaggggaagtgtggatgtcatttccatgaggtagtgaaatcaaagttatccaaagaatataactttattaaaatgaaaagatcaagaaatcatatcatgggaagatatttcagcaatcaaagcaaactacaacaaggcactgtaacaaattttcgatcgccatatcatgtcagaggtccaataaatcaggtttgttctgaaatccttctcagcaggatgtgtgcaaataaaaggactatgtaggctccctgcaggagagctgaatctggagctggagacgagctagtcacccggacaatggtctaggagccaagcgctgcacatcgcacacatttgggatcgaccacacacacttgtgcacaccagcacatgcatgcacaccagtacacacacagttaaataatgataacacttcttacagctttatgaattcaagatgtgaccttgaacaccagtccatttcacagtgaaagatatacctagagaaacgttacttgaagcataattattaaccagaaccactgtgggccaggtatggcattgtgataataaagagaaatatagacacttaaaattatgtgaaaaaaaggataatgctctttcatgttgtcttaccatatctataggtacatcaatattgaaaaggagaaaaaccaatgacattccactggcaagtagaagttgtcctttcattctttaccaggagaaaatgtgatgtttatgatggcttaggctttgtgaatctaatgcttatgaaaaacatttcttcctatactttttaaattttattactgaaaggaaaagaacaggaatgttccacaagggaatttgaagagattctgtgagagagatatgaaatattttatagttaaaacaccaatatattcaactttacacttcttgtgtttttcataaacattccctcttgtcttatctgtgtacttcgatgggtaactgcagtctgaattaatgaaatatgtaattttaaagtaagtaacaaaatgtagttcctcatgtattactgtactatgtttcattgatgatattacttaaatcttgtgtttgccattacagccctatgtaacttaaaattacaattatattttatgtaaatattttgcaaaggactatgcattctgaaatgcataggtgctttttcccaccaagcatttgcatatgtccacaaatagtattatgttactagtatctatattttgattttcctgagcaactgtatcaaatccaaatttagattagacaaaaaattattattttaattaaactgtggcatacatataatacatacctaattatagtagtgagaactatttcttttatctctttaggttcaaaatggtgaatttctttattatatgaatgctttgttgtgagataacatcacactgttacaatggattttagaggtttgtcttttttgggtggggtgggaagctgagagggttaattcaatacatggctgaaattaccaaatgtataaatacctcattttcactaccatacaagaaaaaaacacctattttgattgatcagttcttttgtatgaatatccacctcctttaaatactctatttttatatatatttttatatgaagataaacatgaatttatatttaactgtcttaaattatatttacataaatgcaaatatcacttgatataaacaatacaaatctgcatcttacagatgataatttttttagaagaatgatacagaattaactttaaaaataaaacttttctaatatacacttaaatgcaaacatcatttttaaattttcagtgatttttttaatgacataaaacgttaccaatgtgtgcagcctctccatcatgttttaacatactgtatactctatagcagtattacagtcagtatttcatataattttctttagacctaactgttaccatctgactgaggttactctggtatttatctcttcgctgctgaaataataatggattttagaaacaattgtaataatatcattaataaatgtcttactagtaata

SEQ ID NO: 112867 - DNA, 1056 bp, Homo sapiens
  Payload ID: 2088
  Gene Symbol: CPED1
  Gene Name: cadherin-like and PC-esterase domain containing 1
  ENST ID: ENST00000340646
  CDS Start-End: 448-1056
gcgatgccgaggtcctctgctcccgccgggcgtgcagcgggcgcgcgcgcgtgtgtttatgtgtctgtgtgcgtgtgtgtgtgtgtctctctctgtgtgtgtgtgagatgaattggagtcatacgactgggtgtttccttccgagtggttttcatcagcaatccattaggaaatcatggaaactttttttttcctggctaaaaggatgaaaactgagtcatccacttttgactgtcatccatggaagagctcttattaaaagcctcagactttcgggacctatgattctttggcacaaccttttggaaaattcttaagcagggatgaagcaaacttgattggagttggggaaaaagaagacagattagtatttttcatgctgacaaaaaatagctgctatgacttttcccgcaacgtggacaggggccaagtgaagctgaactggtcatggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaagcagctcaggcggcgggaggagcggcagcggccaggcagcccagcttcgcgaaggctctcggtacgatga

SEQ ID NO: 112868 - DNA, 1118 bp, Homo sapiens
  Payload ID: 2088
  Gene Symbol: CPED1
  Gene Name: cadherin-like and PC-esterase domain containing 1
  ENST ID: ENST00000443817
  CDS Start-End: 116-1118
agtattcgttcacctttcatttgaggagaagctaagtgctgactgccagaggatggaataggaagacaatgaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaa

SEQ ID NO: 112869 - DNA, 2219 bp, Homo sapiens
  Payload ID: 2088
  Gene Symbol: CPED1
  Gene Name: cadherin-like and PC-esterase domain containing 1
  ENST ID: ENST00000428526
  CDS Start-End: 572-2219
aaaactaaatgaagggaagcatacaaaaggctgaaagcaagactgctttaaaaccggaggaaaattgaggaactgctaaggcaacctggcctgagttcagctgtgcaacaggcactttgggttttaatcttttgcgttcttcaatgctgttttcagactccagatatactttggtattgttttctctcttcctgcaaagctgaggcagagtcggactcctttactgtgagttgaaagatgtgagaataaggcattgctggaagcaacagtttggcagcctggggtacactcaggttattcgttacaactattattatttgatgtctttttttaaactcaggtcatccacttttgactgtcatccatggaagagctcttattaaaagcctcagactttcgggacctatgattctttggcacaaccttttggaaaattcttaagcagggatgaagcaaacttgattggagttggggaaaaagaagacagattagtatttttcatgctgacaaaaaatagctgctatgacttttcccgcaacgtggacaggggccaagtgaagctgaactggtcatggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaag

SEQ ID NO: 112870 - DNA, 2501 bp, Homo sapiens
  Payload ID: 2088
  Gene Symbol: CPED1
  Gene Name: cadherin-like and PC-esterase domain containing 1
  Uniprot ID: A4D0V7
  ENST ID: ENST00000450913
  CDS Start-End: 24-2375
ggccaagtgaagctgaactggtcatggtctgtcgcccagtgttcccttgtcgtcggcgattttgcccccgacccttcttggtgggcttagtggtggcaatctgtctcttctaccagactctgaccctccgagggtcgaggaagctcacagccgctgcccctggggctgtcccacacacatccactgaaacccaggcaagcagatgcaagaaaggattctctcaggacaaacagtgcttccttctctctggtaatgcccaggaaaccagaaaggtcaaagaatcaatggagacacactttggcagccatggccgaagggccatactctacaggcctcctttctacagcaaaacagagcttcagctacaccagcacattctgactcaacatggctatacggttgtcatcgctgaagaaaggctcaatgctggcctagggccggggctactagaacaaggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagttgggtgtcgatgtccagagagttcctagaagccgtaattgaagacacaatccagtcatcctgggaccctaaatgacctccctgccccacccctgcacataaacctgacttgaatcacctggactatttttctgagagagtaataaactttaattgggtttgacctat

SEQ ID NO: 112871 - DNA, 2189 bp, Homo sapiens
  Payload ID: 2088
  Gene Symbol: CPED1
  Gene Name: cadherin-like and PC-esterase domain containing 1
  ENST ID: ENST00000423795
  CDS Start-End: 253-1944
aattgaatcatgggtgcggtttcccccatcctattctcgtggtagtgagtaagtctcacgagatctgatggttttataagggattttccctttcacttggccctcattcgctcctgcctgccaccatgtaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggactggagtcgtgaacagctgaatgaaacgacagtccttgctccacatgaaacaatctttcgagccgaagatctatctgtgattcttaaagcgtatgtgttggtgacgtccttaacccctttgcgtgcattcattcattcgacgggcacagtttggaatccaccaaagaaaaaacgcttcactgtcaagctgcaaacattttttgagacattcctgagagccagttcacctcaacaggcttttgacattatgaaggaagcaattggcaaactactgctagcggctgaagtattcagtgaaacatctactctgggaccaaagaccttccatagatgcagattctgctttcaacttctaacttttgatattggttatggcagtttcatgtaccctgtagtgctccaggtacacgagcatttaaattttcaagattatgataatatggattttgaggaccaaaatacagaagaattccttttaaatgacactttcaattttctcttccctaatgaatcatcactttccatattttctgagatatttcagagactttatagatcagatgttttcaagggtgaaaactatcaaaaggaactaaatcagtgtctgtccttagaagaaattaactcaattatgactttcataaaggaacttggaagtctgggacaattccaactgctcttcccatctactactcctgggattcagtcactgatgcatgaattttatgatgtggcaaatcctgtgggaaatcctggctcagtcctgacccaatactggtctcttttaaatgtatttgaacaatttcagttcatgaataaaaagacacagccacatccactggaatggaattctttcacagaagataagaacattgaaaaaccacaagtgccatttgatgcaatagaaaataaaaaagctgcagttccacaaattaaaaatgaaaataaagaaatacattgcagtgatgatgaaaacacaccatgtcatatcaagcagatcttcacacatccacatttggaactaaatcctgactttcatccaaagatcaaagattattactgtgaagtcccatttgatgtggtaacagtgacaattggagtggaaactcctaagtgtctgtgcaaggtgcacctgtacgagcaggcagggccaagctttgccagctaccctctgggcttaggaatgaacaaaatctcaatatttgttgtggatgaatctccagcacacggtgagactctgatcacgtacaaactcaccatctatagagaagaccgcccaagtctgcccttgtttgaggccttcacagcatgtggttttgtgcaggattgtggtttgctgattcatccagaggaaacctgtgggttacagcctatttcttctgactacattgaagccattttacagtctgaactaaaaagatgtccatctggggacatgaaaggccagtggattgtgccttgccttagttgttcggacaacaggacgtgtgactggagagaaataacctggcagccccacaactgccaatatggtgtcctaactaagcctcaactccagcagtgcctgggaggaaggaagttgggtgtcgatgtccagagagttcctagaagccgtaattgaagacacaatccagtcatcctgggaccctaaatgacctccctgccccacccctgcacataaacctgacttgaatcacctggactatttttctgagagagtaataaactttaattgggtttgacctattccaagttttttgggctatctgttacagtgcttagcttatctcacctaatacagggactatgcaaccaagaaactggaaataaaaacaaagataattaaaccattttataataagccta

SEQ ID NO: 112872 - DNA, 553 bp, Homo sapiens
  Payload ID: 2088
  Gene Symbol: CPED1
  Gene Name: cadherin-like and PC-esterase domain containing 1
  ENST ID: ENST00000520801
  CDS Start-End: 1-183
agatgcaagaaaggattctctcaggacaaacagtgcttccttctctctggtaatgcccaggaaaccagaaaggttgagttttttggcttctcagggcagccactagagaagctcgcccctgggtgggggtcgtcctgcaggtgcaaaggtgaagtggactctccttttcaatcagtactgtgagtaggagcttccaggtctgtgcttcagagacagtgaaaacgctgtccttagtttgatgaccacaacaatggtgatctgggctcttgggatctgctcatttgcctgtcttctaagaaagcagaaggaacaccctgtatatccaaggaagtcatgtgccagttaggtttacatcaaaaggcaaacagattaccagaaatacagcagccactttgcagaaaggaaggattatgtcaaatagttagaagattcccagaactgcaacttccagtgagtccctctgtgtgtctggatcagggaatgcaattaaagccgagtacttcgagtcaccttttaaaaacagtgaagccacgtgtgtggaaaccaggggact

SEQ ID NO: 112873 - DNA, 11139 bp, Homo sapiens
  Payload ID: 2089
  Gene Symbol: CDH23
  Gene Name: cadherin-related 23
  ENST ID: ENST00000224721
  CDS Start-End: 391-10470
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgaggtaggagccactgggaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtgaaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatgggtgtcatcactgctgccaaagagctggactacgagatcagccacggccgctacaccctgatcgtcactgccacagaccagtgccccatcttatcccaccgcctcacctctaccaccacggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggggagtttgtgatctctcctgtggagggggtgctaagggtccggaaggacgtggagctggaccgggagaccatcgccttctacaacctgaccatctgtgcccgtgaccgggggatgcccccactcagctccacaatgctggtggggatccgggtgctggacatcaacgacaacgaccctgtgctgctgaacctgcccatgaacatcaccatcagcgagaacagccctgtctccagctttgtcgcccatgtcctggccagtgacgctgacagtggctgcaatgcacgcctcaccttcaacatcactgcgggcaaccgcgagcgggccttcttcatcaatgccacgacagggatcgtcactgtgaaccggcccctggaccgcgagcggatcccagagtacaagctgaccatttctgtgaaggacaacccggagaatccacgcatagccaggagggattatgacttgcttctgatcttcctttctgatgagaatgacaaccaccccctcttcactaaaagcacctaccaggcagaggtgatggaaaactctcccgctggcacccctctcacggtgctcaatgggcccatcctggccctggatgcagaccaagacatctacgccgtggtgacctaccagctgctgggtgcccagagtggcctctttgacatcaacagcagcaccggtgtggtgaccgtgaggtcaggtgtcatcattgaccgggaggcattctcgccacccatcctggagctgctgctgctggctgaggacatcgggctgctcaacagcacggcccacctgctcatcaccatcctggatgacaatgacaaccggcccacctttagccctgccaccctcactgtccatctgctagagaactgcccgcctggattctcagtccttcaagtcacagccacagatgaggacagtggcctcaatggggagctggtctaccgaatagaagctggggctcaggaccgcttcctcattcatctggtcaccggggtcatccgtgttggtaatgccaccatcgacagagaggagcaggagtcctacaggctaacggtggtggccaccgaccggggcaccgttcctctctcgggcacagccattgtcaccattctgatcgatgacatcaatgactcccgccccgagttcctcaaccccatccagacagtgagcgtgctggagtcggctgagccaggcactgtcattgccaatatcacggccattgaccacgacctcaacccaaagctagagtaccacattgtcggcattgtggccaaggacgacactgatcgcctggtgcccaaccaggaggacgcctttgctgtgaatatcaacacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctcaa
